US011319531B2

(12) United States Patent
Nazor et al.

(10) Patent No.: US 11,319,531 B2
(45) Date of Patent: May 3, 2022

(54) TRANSGLUTAMINASE VARIANTS

(71) Applicant: Codexis, Inc., Redwood City, CA (US)

(72) Inventors: Jovana Nazor, Milpitas, CA (US); Jie Yang, Foster City, CA (US); Goutami Banerjee, Hayward, CA (US); Xiyun Zhang, Fremont, CA (US); James Nicholas Riggins, San Francisco, CA (US); Erika M. Milczek, New York, NY (US); Jeffrey C. Moore, Westfield, NJ (US)

(73) Assignee: Codexis, Inc., Redwood City, CA (US)

( * ) Notice: Subject to any disclaimer, the term of this patent is extended or adjusted under 35 U.S.C. 154(b) by 0 days.

(21) Appl. No.: 16/652,941

(22) PCT Filed: Nov. 2, 2018

(86) PCT No.: PCT/US2018/059049
§ 371 (c)(1),
(2) Date: Apr. 1, 2020

(87) PCT Pub. No.: WO2019/094301
PCT Pub. Date: May 16, 2019

(65) Prior Publication Data
US 2020/0263150 A1 Aug. 20, 2020

Related U.S. Application Data

(60) Provisional application No. 62/582,593, filed on Nov. 7, 2017.

(51) Int. Cl.
*C12N 9/10* (2006.01)
*C07K 14/62* (2006.01)
*C12N 15/63* (2006.01)

(52) U.S. Cl.
CPC ............ *C12N 9/1044* (2013.01); *C07K 14/62* (2013.01); *C12N 15/63* (2013.01); *C12Y 203/02013* (2013.01)

(58) Field of Classification Search
CPC ...... C12N 9/1044; C12N 15/63; C07K 14/62; C12Y 203/02013
See application file for complete search history.

(56) References Cited

U.S. PATENT DOCUMENTS

| | | | |
|---|---|---|---|
| 5,605,793 A | 2/1997 | Stemmer |
| 5,811,238 A | 9/1998 | Stemmer et al. |
| 5,830,721 A | 11/1998 | Stemmer et al. |
| 5,834,252 A | 11/1998 | Stemmer et al. |
| 5,837,458 A | 11/1998 | Minshull et al. |
| 5,928,905 A | 7/1999 | Stemmer et al. |
| 6,013,498 A | 1/2000 | Yokoyama et al. |
| 6,096,548 A | 8/2000 | Stemmer |
| 6,117,679 A | 9/2000 | Stemmer |
| 6,132,970 A | 10/2000 | Stemmer |
| 6,165,793 A | 12/2000 | Stemmer |
| 6,180,406 B1 | 1/2001 | Stemmer |
| 6,190,879 B1 | 2/2001 | Bech et al. |
| 6,251,674 B1 | 6/2001 | Tobin et al. |
| 6,265,201 B1 | 7/2001 | Wackett et al. |
| 6,277,638 B1 | 8/2001 | Stemmer |
| 6,287,861 B1 | 9/2001 | Stemmer et al. |
| 6,287,862 B1 | 9/2001 | delCardayre et al. |
| 6,291,242 B1 | 9/2001 | Stemmer |
| 6,297,053 B1 | 10/2001 | Stemmer |
| 6,303,344 B1 | 10/2001 | Patten et al. |
| 6,309,883 B1 | 10/2001 | Minshull et al. |
| 6,319,713 B1 | 11/2001 | Patten et al. |
| 6,319,714 B1 | 11/2001 | Crameri et al. |
| 6,323,030 B1 | 11/2001 | Stemmer |
| 6,326,204 B1 | 12/2001 | delCardayre et al. |
| 6,335,160 B1 | 1/2002 | Patten et al. |
| 6,335,198 B1 | 1/2002 | delCardayre et al. |
| 6,337,186 B1 | 1/2002 | Krebber |
| 6,344,356 B1 | 2/2002 | Stemmer |
| 6,352,859 B1 | 3/2002 | delCardayre et al. |
| 6,355,484 B1 | 3/2002 | Patten et al. |
| 6,358,740 B1 | 3/2002 | Patten et al. |
| 6,358,742 B1 | 3/2002 | Stemmer |
| 6,365,377 B1 | 4/2002 | Patten et al. |
| 6,365,408 B1 | 4/2002 | Stemmer |
| 6,368,861 B1 | 4/2002 | Crameri et al. |
| 6,372,497 B1 | 4/2002 | Stemmer |
| 6,376,246 B1 | 4/2002 | Crameri et al. |
| 6,379,964 B1 | 4/2002 | delCardayre et al. |
| 6,387,702 B1 | 5/2002 | Stemmer |

(Continued)

FOREIGN PATENT DOCUMENTS

| | | |
|---|---|---|
| EP | 137280 B1 | 3/1992 |
| EP | 0785 276 A1 | 7/1997 |

(Continued)

OTHER PUBLICATIONS

Singh RK et al. Protein Engineering Approaches in the Post-Genomic Era. 2017. Current Protein and Peptide Science. 18, 1-11. (Year: 2017).*
Zhang M et al. Propagated Perturbations from a Peripheral Mutation Show Interactions Supporting WW Domain Thermostability. 2018. Structure. 26, 1474-1485. (Year: 2018).*
Yang H et al. Whole-Genome Shotgun Assembly and Analysis of the Genome of Streptomyces mobaraensis DSM 40847, a Strain for Industrial Production of Microbial Transglutaminase. 2013. Genome Announcements. vol. 1, Issue 2. p. 1-2. (Year: 2013).*
Altschul, S., et al., "Basic local alignment search tool," J. Mol. Biol., 215: 403-410 (1990).
Altschul, S.F., et al., "Gapped BLAST and PSI-BLAST: a new generation of protein database search programs," Nucleic Acids Res., 25(17):3389-3402 (1997).

(Continued)

*Primary Examiner* — Paul J Holland
(74) *Attorney, Agent, or Firm* — Codexis, Inc.

(57) ABSTRACT

The present invention provides engineered transglutamirase enzymes, polynucleotides encoding the enzymes, compositions comprising the enzymes, methods of producing these enzymes, and methods of using the engineered transglutaminase enzymes.

8 Claims, No Drawings
Specification includes a Sequence Listing.

(56) References Cited

U.S. PATENT DOCUMENTS

| | | |
|---|---|---|
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |
| 6,406,910 B1 | 6/2002 | Patten et al. |
| 6,413,745 B1 | 7/2002 | Patten et al. |
| 6,413,774 B1 | 7/2002 | Stemmer |
| 6,420,175 B1 | 7/2002 | Stemmer |
| 6,423,542 B1 | 7/2002 | Crameri et al. |
| 6,426,224 B1 | 7/2002 | Crameri et al. |
| 6,436,675 B1 | 8/2002 | Welch et al. |
| 6,444,468 B1 | 9/2002 | Stemmer et al. |
| 6,455,253 B1 | 9/2002 | Patten et al. |
| 6,479,652 B1 | 11/2002 | Crameri et al. |
| 6,482,647 B1 | 11/2002 | Stemmer |
| 6,483,011 B1 | 11/2002 | Stemmer et al. |
| 6,484,105 B2 | 11/2002 | Zhang |
| 6,489,146 B2 | 12/2002 | Stemmer et al. |
| 6,500,617 B1 | 12/2002 | Stemmer et al. |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,538,122 B1 | 5/2003 | Yokoyama et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,605,430 B1 | 7/2003 | Affholter et al. |
| 6,602,986 B1 | 8/2003 | Stemmer et al. |
| 6,613,514 B2 | 9/2003 | Patten et al. |
| 6,653,072 B1 | 11/2003 | Patten et al. |
| 6,686,515 B1 | 2/2004 | Lassner et al. |
| 6,703,240 B1 | 3/2004 | Stemmer et al. |
| 6,716,631 B1 | 4/2004 | delCardayre et al. |
| 6,821,763 B2 | 11/2004 | Yokoyama et al. |
| 6,825,001 B2 | 11/2004 | Wackett et al. |
| 6,902,922 B2 | 6/2005 | Ness et al. |
| 6,917,882 B2 | 7/2005 | Selfinov et al. |
| 6,946,296 B2 | 9/2005 | Patten et al. |
| 6,961,664 B2 | 11/2005 | Selfinov et al. |
| 6,995,017 B1 | 2/2006 | Stemmer |
| 7,024,312 B1 | 4/2006 | Selfinov et al. |
| 7,058,515 B1 | 6/2006 | Selfinov et al. |
| 7,105,297 B2 | 9/2006 | Minshull et al. |
| 7,148,054 B2 | 12/2006 | delCardayre et al. |
| 7,220,566 B2 | 5/2007 | Ness et al. |
| 7,288,375 B2 | 10/2007 | Stemmer et al. |
| 7,384,387 B1 | 6/2008 | Raillard et al. |
| 7,399,627 B2 | 7/2008 | Emalfarb et al. |
| 7,421,347 B2 | 9/2008 | Selfinov et al. |
| 7,430,477 B2 | 9/2008 | Selfinov et al. |
| 7,462,469 B2 | 12/2008 | Bass et al. |
| 7,534,564 B2 | 5/2009 | Patten et al. |
| 7,620,500 B2 | 11/2009 | Mundorff et al. |
| 7,620,502 B2 | 11/2009 | Selfinov et al. |
| 7,629,157 B2 | 12/2009 | Davis et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selfinov et al. |
| 7,868,138 B2 | 1/2011 | Stemmer et al. |
| 7,873,477 B1 | 1/2011 | Gustafsson et al. |
| 7,873,499 B2 | 1/2011 | Selfinov et al. |
| 7,904,249 B2 | 3/2011 | Selfinov et al. |
| 7,957,912 B2 | 6/2011 | Selfinov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Crameri et al. |
| 8,076,138 B2 | 12/2011 | delCardayre et al. |
| 8,108,150 B2 | 1/2012 | Mundorff et al. |
| 8,170,806 B2 | 5/2012 | Selfinov et al. |
| 8,224,580 B2 | 7/2012 | Mundorff et al. |
| 8,377,681 B2 | 2/2013 | delCardayre et al. |
| 8,383,346 B2 | 2/2013 | Colbeck et al. |
| 8,457,903 B1 | 6/2013 | Emig et al. |
| 8,504,498 B2 | 8/2013 | Fox |
| 8,589,085 B2 | 11/2013 | Selfinov et al. |
| 8,762,066 B2 | 6/2014 | Fox |
| 8,768,871 B2 | 7/2014 | Fox |
| 9,593,326 B2 | 3/2017 | Clark et al. |
| 2004/0002144 A1 | 1/2004 | Kashiwagi et al. |
| 2006/0195947 A1 | 8/2006 | Davis et al. |
| 2006/0275872 A1 | 12/2006 | Kashiwagi et al. |
| 2008/0220990 A1 | 9/2008 | Fox |
| 2009/0312196 A1 | 12/2009 | Colbeck et al. |
| 2010/0087371 A1 | 4/2010 | Hu et al. |
| 2010/0099610 A1 | 4/2010 | Hu et al. |
| 2010/0249029 A1 | 9/2010 | Breinholt et al. |
| 2016/0178627 A1* | 6/2016 | Albert .............. C07K 7/06 435/7.4 |
| 2016/0244787 A1 | 8/2016 | Chan et al. |

FOREIGN PATENT DOCUMENTS

| | | |
|---|---|---|
| EP | 0950 665 A1 | 10/1999 |
| EP | 0889133 B1 | 3/2004 |
| WO | 95/22625 A1 | 8/1995 |
| WO | 95/33836 A1 | 12/1995 |
| WO | 96/00787 A1 | 1/1996 |
| WO | 97/0078 A1 | 1/1997 |
| WO | 97/35966 A1 | 10/1997 |
| WO | 98/27230 A1 | 6/1998 |
| WO | 00/42651 A1 | 7/2000 |
| WO | 01/75767 A2 | 10/2001 |
| WO | 2005/070468 A2 | 8/2005 |
| WO | 2006/134148 A2 | 12/2006 |
| WO | 2008/020075 A1 | 2/2008 |
| WO | 2008/102007 A1 | 8/2008 |
| WO | 2009/003732 A2 | 1/2009 |
| WO | 2009/030211 A2 | 3/2009 |
| WO | 2009/152336 A1 | 12/2009 |
| WO | 2010/144103 A1 | 12/2010 |
| WO | 2016/170447 A1 | 10/2016 |
| WO | 2017/059158 A1 | 4/2017 |
| WO | 2017/059160 A1 | 4/2017 |
| WO | 2019/094301 A1 | 5/2019 |

OTHER PUBLICATIONS

Ando, H., et al., "Purification and Characteristics of a Novel Transglutaminase Derived from Microorganisms," Agric. Biol. Chem., 53(10):2613-2617 [1989].

Beaucage, S.L., et al., "Deoxynucleoside phosphoamidites—A new class of key intermediates for deoxypolynucleotide synthesis," Tetrahedron Letters, 22(20):1859-62 (1981).

Blaiseau, P-L., et al., "Primary structure of a chitinase-encoding gene (chi1) from the filamentous fungus *Aphanocladium album*: similarity to bacterial chitinases," Gene, 120:243-248 [1992].

Boel, E., et al., "Two different types of intervening sequences in the glucoamylase gene from *Aspergillus niger*," EMBO J., 3:1581-85 [1984].

Botstein, D., et al., "Strategies and applications of in vitro mutagenesis," Science, 229(4719):1193-1201 [1985].

Carter, P., "Site-directed mutagenesis," Biochem. J., 237:1-7 (1986).

Chaveroche, M., et al., "A rapid method for efficient gene replacement in the filamentous fungus *Aspergillus nidulans*," Nucl. Acids Res., 28:22 e97 [2000].

(56) References Cited

OTHER PUBLICATIONS

Cho, Y., et al., "A high throughput targeted gene disruption method for Alternaria brassicicola functional genomics using linear minimal element (LME) constructs," Mol Plant Microbe Interact, 19(1):7-15 [2006].
Christians, F.C., et al., "Directed evolution of thymidine kinase for AZT phosphorylation using DNA family shuffling," Nat. Biotechnol., 17:259-264 (1999).
Combier, J.-P., et al., "Agrobacterium tumefaciens-mediated transformation as a tool for insertional mutagenesis in the symbiotic ectomycorrhizal fungus *Hebeloma cylindrosporum*," FEMS Microbiol Lett., 220:141-8 [2003].
Crameri, A., et al., "DNA shuffling of a family of genes from diverse species accelerates directed evolution", Nature, 391:288-291 (1998).
Crameri, A., et al., "Improved green fluorescent protein by molecular evolution using DNA shuffling,"Nat. Biotechnol., 14(3):315-319 (1996).
Crameri, A., et al., "Molecular evolution of an arsenate detoxification pathway by DNA shuffling," Nat. Biotechnol., 15(5):436-438 (1997).
Dale, S.J., et al., "Oligonucleotide-directed random mutagenesis using the phosphorothioate method," Methods Mol. Biol., 57:369-74 (1996).
De Boer, H.A., et al., "The tac promoter: Afunctional hybrid derived from the trp and lac promoters," Proc. Natl Acad. Sci. USA, 80:21-25 (1983).
Dennler, P., et al., "Transglutaminase-Based Chemo-Enzymatic Conjugation Approach Yields Homogeneous Antibody—Drug Conjugates," Bioconj. Chem., 25:569-578 [2014].
Ehrlich, S.D., "DNA cloning in Bacillus subtilis," Proc Natl Acad Sci. USA, 75:1433 (1978).
Eisenberg, D., et al., "Analysis of Membrane and Surface Protein Sequences with the Hydrophobic Moment Plot," J. Mol. Biol., 179:125-142 [1984].
Firon, A., et al., "Identification of Essential Genes in the Human Fungal Pathogen Aspergillus fumigatus by Transposon Mutagenesis," Eukaryot. Cell, 2(2):247-55 [2003].
Grunberg, J., et al., "DOTA-Functionalized Polylysine: A High Number of DOTA Chelates Positively Influences the Biodistribution of Enzymatic Conjugated Anti-Tumor Antibody chCE7agl," PLoS ONE, 8(4):e60350, pp. 1-10 [2013].
Guo, Z., et al., "3'-End-Forming Signals of Yeast mRNA," MoL Cell. Biol., 15(11):5983-5990 [1995].
HENAUT and Danchin in Neidhardt et al. [eds.], *Escherichia coli* and *Salmonella*," Analysis and predictions from *Escherichia coli* Sequences, or *E. coli* in silico," ASM Press, Washington DC, [1987], pp. 2047-2066.
Henikoff, S., et al., "Amino acid substitution matrices from protein blocks," Proc. Natl. Acad. Sci., 89:10915-10919 (1992).
Hong, J., et al., "Cloning and functional expression of thermostable beta-glucosidase gene from Thermoascus aurantiacus," Appl. Microbiol. Biotechnol, 73:1331-1339 [2007].
Jeger, S., et al., "Site-Specific and Stoichiometric Modification of Antibodies by Bacterial Transglutaminase," Angew. Chem. Int., 49:9995-9997 [2010].
Kanaji, T., et al., "Primary Structure of Microbial Transglutaminase from *Streptoverticillium* sp. Strain s-8112," J. Biol. Chem., 268(16):11565-11572 [1993].
Kashiwagi, T., et al., "Crystal Structure of Microbial Transglutaminase from Streptoverticillium mobaraense," J. Biol. Chem., 277(46):44252-44260 [2002].
Kieliszek, M., et al., "Microbial transglutaminase and its application in the food industry. A review," Folia Microbiol., 59:241-250 [2014].
Kramer, B., et al., "Different base/base mismatches are corrected with different efficiencies by the methyl-directed DNA mismatch-repair system of *E. coli*," Cell, 38(3):879-887, 1984.
Kuraishi, C., et al., "Transglutaminase: Its Utilization in the Food Industry," Food Rev. Inti., 17(2):221-246 [2001].
Lathe, R., et al., "Plasmid and bacteriophage vectors for excision of intact inserts," Gene, 57:193-201 (1987).
Lhospice, F., et al., "Site-Specific Conjugation of Monomethyl Auristatin E to Anti-CD30 Antibodies Improves Their Pharmacokinetics and Therapeutic Index in Rodent Models," Mol. Pharmaceutics, 12:1863-1871 [2015].
Limon, C., et al., "Primary structure and expression pattern of the 33-kDa chitinase gene from the nucoparasitic fungus *Trichocherma harzianum*," Curr. Genet., 28:478-83 [1995].
Ling, M., et al., "Approaches to DNA Mutagenesis:An Overview," Anal. Biochem., 254:157-78 (1997).
Martins, I.M., et al., "Transglutaminases: recent achievements and new sources," Appl. Microbiol. Biotechnol., 98:6957-6964 [2014].
Maruyama, J., "Multiple gene disruptions by marker recycling with highly efficient gene-targeting background (delta-igD) in Aspergillus oryzae," Biotechnol Lett., 30:1811-1817 [2008].
Matthes, H.W.D., et al., "Simultaneous rapid chemical synthesis of over one hundred oligonucleotides on a microscale," EMBO J., 3(4):801-05 (1984).
McInerney, J.O., "Gcua: general codon usage analysis," Bioinformatics, 14(4):372-73 [1998].
Mindt, T.L., et al., "Modification of Different IgG1 Antibodies via Glutamine and Lysine using Bacterial and Human Tissue Transglutaminase," Bioconj. Chem., 19:271-278 [2008].
Minshull, J., et al., "Protein evolution by molecular breeding," Curr. Op. Chem. Biol., 3(3):284-290 (1999).
Motoki, M., et al., "Transglutaminase and its use for food processing," Trends Food Sci. Technol., 9:204-210 [1998].
Nakamura, Y., et al., "Codon usage tabulated from international DNA sequence databases: status for the year 2000," Nucl. Acids Res., 28:292 [2000].
Needleman, S., et al., "A general method applicable to the search for similarities in the amino acid sequence of two proteins," J. Mol. Biol. 48:443-453 (1970).
Nunberg, J.H., et al., "Molecular Cloning and Characterization of the Glucoamylase Gene of Aspergillus awamori," Mol. Cell Biol., 4(11):2306-2315 [1984].
Parry, N.J., et al., "Biochemical characterization and mechanism of action of a thermostablebeta-glucosidase purified from Thermoascus aurantiacus," Biochem. J., 353:117-127 [2001].
Pearson, W.R., "Improved tools for biological sequence comparison," Proc. Natl. Acad. Sci. USA, 85:2444-2448 (1988).
Porath, J., "Immobilized metal ion affinity chromatography," Protein Expression and Purification, 3:263-281 (1992).
Romanos, M.A., et al., "Foreign gene expression in yeast: a review," Yeast 8:423-488 [1992].
Santos, M., et al., "Recent Patents on Transglutaminase Production and Applications: A Brief Review," Rec. Patents Biotechnol., 3:166-174 [2009].
Sato, H., "Enzymatic procedure for site-specific pegylation of proteins," Adv. Drug Deliv. Rev., 54:487-504 [2002].
Simonen, M., et al., "Protein Secretion in Bacillus Species," Microbiological Reviews, 57:109-137 (1993).
Smith, M., "In vitro mutagenesis," Ann. Rev. Genet., 19:423-462 (1985).
Smith, T., et al., "Comparison of Biosequences," Adv. Appl. Math, 2:482-489 (1981).
Stemmer, W., "DNA Shuffling by Random Fragmentation and Reassembly: In vitro Recombination for Molecular Evolution," Proc. Natl. Acad. Sci. USA, 91:10747-10751 (1994).
Stemmer, W.P.C., "Rapid evolution of a protein in vitro by DNA shuffling", Nature, 370:389-391 (1994).
Stenico, M., et al., "Codon usage in Caenorhabditis elegans: delineation of translational selection and mutational biases," Nucl. Acids Res. 22(13):2437-46 [1994].
Takahashi, T., et al., "Efficient gene disruption in the koji-mold Aspergillus sojae using a novel variation of the positive-negative method," Mol. Gen. Genom., 272: 344-352 [2004].
Taussig, R., et al., "Nucleotide sequence of the yeast SUC2 gene for invertase," Nucl. Acids Res., 11(6):1943-54 [1983].
Tiwari, S., et al., "Prediction of probable genes by Fourier analysis of genomic sequences," Comput. Appl. Biosci. (3):263-270 [1997].

(56) References Cited

OTHER PUBLICATIONS

Uberbacher, E.C., et al., "Discovering and Understanding Genes in Human DNA Sequence Using GRAIL," Methods Enzymol., 266:259-281 [1996].
Valdivia, A., et al., "Transglutaminase-catalyzed site-specific glycosidation of catalase with aminated dextran," J. Biotechnol., 122:326-333 [2006].
Villa-Komaroff, L., et al., "A bacterial clone synthesizing proinsulin," Proc. Natl Acad. Sci. USA, 75:3727-3731 (1978).
Wada, E., et al., "Enzymatic modification of β-lactoglobulin with N-fatty-acyl-dipeptide by transglutaminase from Streptomyces mobaraense," Biotech. Lett., 23:1367-1372 [2001].
Wada, K., et al., "Codon usage tabulated from the GenBank genetic sequence data," Nucl. Acids Res., 20:2111-2118 [1992].
Washizu, K.,et al., "Molecular Cloning of the Gene for Microbial Transglutaminase from Streptoverticillium and Its Expression in Streptomyces lividans," Biosci. Biotech. Biochem., 58:82-87 [1994].
Wells, J.A., et al., "Cassette mutagenesis: an efficient method for generation of multiple mutations at defined sites," Gene, 34:315-323 (1985).
Wilson, I.A., et al., "The structure of antigenic determinant in a protein," Cell, 37:767-778 [1984].
Wright, F., "The 'effective number of codons' used in a gene," Gene 87:23-29 [1990].
Yokoyama, K., et al., "Properties and applications of microbial transglutaminase," Appl. Microbiol. Biotechol., 64:447-454 [2004].
You, B., et al., "Gene-specif disruption in the fillamentous fungus *Cercospora nicotianae* using a split-marker approach," Arch Micriobiol., 191:615-622 [2009].
Zhang, J-H., et al., "Directed evolution of a fucosidase from a galactosidase by DNA shuffling and screening ," Proc. Nat. Acad. Sci., U.S.A., 94:4504-4509 (1997).
SwissProt Accession No. P00724 dated Feb. 22, 2012.
Malten, M., et al., "A Bacillus megaterium Plasmid System for the Production, Export, and One-Step Purification of Affinity-Tagged Heterologous Levansucrase from Growth Medium," Applied and Environmental Microbiology, 72 (2):1677-1679 [2006].
Yokoyama, K., et al., "Screening for improved activity of a transglutaminase from Streptomyces mobaraensis created by a novel rational mutagenesis and random mutagenesis," Appl. Microbiol. Biotechol., 87(6):2087-2096 [2010].
Supplementary Partial European Search Report from EP application No. 18875439 dated Aug. 5, 2021.

\* cited by examiner

TRANSGLUTAMINASE VARIANTS

The present application is a national stage application filed under 35 USC §371 and claims priority to international application to PCT International Application No. PCT/US18/59049, filed Nov. 2, 2018, which claims priority to U.S. Prov. Pat. Appln. Ser. No. 62/582,593, filed Nov. 7, 2017, which is incorporated by reference in its entirety for all purposes.

FIELD OF THE INVENTION

The present invention provides engineered transglutaminase enzymes, polynucleotides encoding the enzymes, compositions comprising the enzymes, methods of producing these enzymes, and methods of using the engineered transglutaminase enzymes.

REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX2-164USP1_ST25.txt", a creation date of Nov. 7, 2017, and a size of 1,896 kilobytes. The Sequence Listing filed via EFS-Web is part of the specification and is incorporated in its entirety by reference herein.

BACKGROUND OF THE INVENTION

Transglutaminases (TGase; EP 2.3.2.13)(R-gluaminyl-peptide-aminase-gamma-glutamyltransferase) comprise an enzyme family that catalyze post-translational modifications in proteins, producing covalent amide bonds between a primary amine group in a polyamine or lysine (i.e., an amine donor) and a gamma-carboxyamide group of the glutamyl residue of some proteins and polypeptides (i.e., an amine acceptor). The result of this enzymatic action include modification of the protein's conformation and/or extensive conformation changes resulting from the bonding of the same and different proteins to produce high molecular weight conjugates. These enzymes find use various applications, including in the food, cosmetic, textile, and pharmaceutical industries.

SUMMARY OF THE INVENTION

The present invention provides engineered transglutaminase enzymes, polynucleotides encoding the enzymes, compositions comprising the enzymes, and methods of using the engineered transglutaminase enzymes.

The present invention provides engineered transglutaminases having at least 85%, 90%, 91%, 92%, 93%, 94%, 95%, 96%, 97%, 98%, 99% or more sequence identity to SEQ ID NO: 2, 6, 34, and/or 256. In some embodiments, the engineered transglutaminases have at least 85%, 90%, 91%, 92%, 93%, 94%, 95%, 96%, 97%, 98%, 99% or more sequence identity to SEQ ID NO:6, and at least one substitution or substitution set at one or more positions selected from positions 79, 101, 101/201/212/287, 101/201/285, 101/287, and 327, wherein said positions are numbered with reference to SEQ ID NO:6. In some embodiments, the engineered transglutaminases have at least 85%%, 90%, 91%, 92%, 93%, 94%, 95%, 96%, 97%, 98%, 99% or more sequence identity to SEQ ID NO:2, and at least one substitution or substitution set at one or more positions selected from positions 48, 48/67/70, 48/67/70/181/203/256, 48/67/70/181/256/345, 48/67/70/181/296/345/373, 48/67/70/203/256/296/345, 48/67/70/203/256/345/354/373, 48/67/70/203/345, 48/67/70/256, 48/67/70/256/296/345/373, 48/67/203/256/296/373, 48/67/203/256/345, 48/70/170/203, 48/70/203/254/296/343, 48/70/203/256/345/373, 48/70/203/256/345, 48/70/203/373, 48/170/203, 48/170/203/254/296/346, 48/170/203/254/296/346/373, 48/170/203/254/346/373, 48/170/203/254/346, 48/170/203/296/343/346, 48/170/203/296/346/373, 48/170/203/343/346, 48/170/203/346, 48/170/203/346/373, 48/170/203/373, 48/170/254, 48/170/296, 48/170/296/343/346, 48/170/343/346, 48/181, 48/181/203/256/345, 48/181/203/345, 48/181/256/296/345, 48/181/296, 48/181/296/345, 48/203, 48/203/254/296, 48/203/254/296/343/373, 48/203/254/296/346/373, 48/203/254/346, 48/203/254/346/373, 48/203/256, 48/203/256/296/345, 48/203/296/343/346/373, 48/203/296/343/373, 48/203/296/346, 48/203/296/346/373, 48/203/343/346, 48/203/343/346/373, 48/203/345, 48/203/346, 48/203/346/373, 48/254/296, 48/254/346, 48/256, 48/256/296, 48/256/296/345, 48/296/345, 48/296/373, 48/343/346, 48/345/373, 67/256, 67/296/345, 68/74/190/215/346, 68/136/215/255/282/297/346, 68/136/215/297/346, 68/136/234, 68/158/174/234/282/297/346, 68/158/215/297/346, 68/215/297/346, 68/234, 68/282/297/346, 68/297/346, 74/136/174/282/346, 74/136/174/297/346, 74/136/346, 74/158/255/297, 74/255/346, 74/346, 136/158/190/215/255/297/346, 136/158/215/297/346, 136/174/215/255/282/297/346, 136/190/215/297/346, 136/215/234/282/297, 136/215/234/297/346, 136/215/297, 136/297/346, 158/215/255/346, 158/215/346, 170/203/254/296/343/346, 170/203/254/343/373, 170/203/343/346, 174/190/234/297/346, 174/215/234/297/346, 174/215/255/297/346, 174/282/297/346, 190/255/282/346, 190/297/346, 203/296, 203/343, 203/343/346, 203/346, 215/255/297/346, 215/234/297/346, 215/255/297/346, 215/297, 215/297/346, 215/346, 234/255/346, 255/297/346, 255/346, 297/346, 343/346/373, and 346, wherein said positions are numbered with reference to SEQ ID NO:2. In some additional embodiments, the engineered transglutaminases have at least 85%, 90%, 91%, 92%, 93%, 94%, 95%, 96%, 97%, 98%, 99% or more sequence identity to SEQ ID NO: 2, and at least one substitution or substitution set at one or more positions selected from 33/67/70/181/203/256/296/373, 36/48/203/254/346, 48/67/70/181/203/256/296/373, 48/67/70/203/256/296/373, 48/67/70/181/203/256/296/373, 48/67/181/203/256/296/373, 48/67/181/256/373, 48/67/181/256/296, 48/67/203/256/296/373/378, 48/67/203/256/373, 48/67/203/296/373, 48/67/256/296/373, 48/70/181/203/256/296/373, 48/70/181/203/256/373, 48/70/181/203/296/373, 48/70/203/256/296/373, 48/70/203/256/373, 48/70/203/296, 48/70/203/296/373, 48/70/203/373, 48/70/256/296/373, 48/70/296/373, 48/176/203/254/346/373, 48/181/203/256/296/373, 48/181/203/256/373, 48/181/203/296, 48/181/203/373, 48/181/256/296/373, 48/203/254, 48/203/254/343, 48/203/254/343/346/373, 48/203/254/343/355/373, 48/203/254/343/373, 48/203/254/346/373, 48/203/254/373, 48/203/256/296, 48/203/256/296/373, 48/203/256/373, 48/203/296/373, 48/203/296/373/374, 48/203/343/373, 48/203/373, 48/254, 48/254/343/346/373, 48/254/343/373, 48/254/346/373, 48/254/373, 48/256/296/373, 48/256/373, 48/373, 67/70/181/203/256/296/373, 67/70/181/256/296/373, 67/70/181/373, 67/181/203/256/296, 67/181/203/256/296/373, 67/181/203/256/373, 67/203/256/296/373, 67/256/296/373, 70/181/203/256/296/373, 70/181/203/296/373, 70/203, 70/203/256/296/373, 70/203/256/373, 70/203/296/373, 74/136/215/234/282/297/346, 74/136/215/234/282/346, 74/136/215/234/297, 74/136/215/234/297/343/346, 74/136/215/234/297/346, 74/136/215/

234/346, 74/136/215/282/297/346, 74/136/215/282/346, 74/136/215/282/346, 74/136/215/297/346, 74/136/215/346, 74/136/234/282/297/346, 74/136/234/346, 74/136/282/297/346, 74/215, 74/215/234/282/297/346, 74/215/282/297/346, 74/215/346, 136/215/234/282/297/346, 136/215/282/297, 136/215/282/297/346, 136/215/282/346, 136/215/297/346, 136/215/346, 136/234/297, 136/234/297/346, 136/234/346, 136/282/297, 181/203/256, 181/203/256/296, 181/203/256/296/373, 181/203/256/373, 181/203/296/373, 181/203/373, 181/256/296/373, 181/296, 203/224/254/373, 203/254, 203/254/343/346/373, 203/254/343/373, 203/254/346, 203/254/346/373, 203/254/373, 203/346/373, 203/373, 203/209/256/373, 203/256, 203/256/296, 203/256/296/320/373, 203/256/296/373, 203/256/296/373/386, 203/256/373, 203/296/373, 203/373, 215/234/282/297/346, 215/234/282/346, 215/234/346, 234/282/346, 254, 254/346, 254/346/373, 254/373, 256/296, 256/296/373, 256/373, 282/297/346, 343/373, and 373, wherein said positions are numbered with reference to SEQ ID NO: 2. In some further embodiments, the engineered transglutaminases have at least 850/%, 90%, 91%, 92%, 93%, 94%, 95%, 96%, 97%, 98%, 99%6 or more sequence identity to SEQ ID NO: 34, and at least one substitution or substitution set at one or more positions selected from 48/49, 49, 50, 50, 331, 291, 292, 330, and 331, wherein said positions are numbered with reference to SEQ ID NO: 34. In yet some additional embodiments, the engineered transglutaminases have at least 85%, 90%, 91%, 92%, 93%, 94%, 95%, 96%, 97%, 98%, 99% or more sequence identity to SEQ ID NO: 256, and at least one substitution or substitution set at one or more positions selected from 27/48/67/70/74/234/256/282/346/373, 27/48/67/70/136/203/215/256/282/346/373, 27/48/67/70/346/373, 27/48/67/74/203/256/346/373, 27/67/234/296/373, 45/287/328/333, 45/292/328, 48, 48/284/292/333, 48/287/292/297, 48/287/297/328/333, 48/292, 48/292/297, 48/49/50/292/331, 48/49/50/292, 48/49/50/331, 48/49/330/331, 48/49/50/349, 48/49/50/291/292/331, 48/49/50/292/331, 48/67/70/203/215/234/256/346, 48/67/70/234/256/282/297/346, 48/67/70/346, 48/67/74/203/234/256/282/346/373, 48/67/74/234/297/346/373, 48/67/74/346, 48/67/203/346/373, 48/67/234/256/297/346/373, 48/67/234/256/346/373, 48/67/215/282/297/346/373, 48/67/346/373, 48/70/74/297/346/373, 48/70/203/215/256/282/346/373, 48/70/215/234/256/346/373, 48/74/203/234/256/346/373, 48/74/234/256/297/346/373, 48/136/256/346/373, 48/203/234/256/297/346/373, 48/203/234/256/346/373, 48/203/234/346/373, 48/203/296/373, 48/215/234/346/373, 48/215/346/373, 48/234/256/296/346/373, 48/234/256/346/373, 48/256/373, 49/50/292/331, 49/50/292/331/349, 49/50/331, 49/50/331/349, 50, 67/70/74/136/203/215/256/346/373, 67/70/74/203/215/234/346/373, 67/70/74/215/234/297/346/373, 67/70/74/215/256/373, 67/70/136/203/297/346/373, 67/70/203/215/256/346/373, 67/70/203/373, 67/70/215, 67/74/136, 67/74/203/234/256, 67/74/215/256/297/346/373, 67/74/215/346/373, 67/74/256/346/373, 67/136/203/215/256/346/373, 67/136/203/256/346/373, 67/203/234/256/346/373, 67/203/297/346/373, 67/215/234/297/346/373, 67/297/346, 70/74/203/215/346/373, 136, 136/346/373, 203/234/346, 203/234/346/373, 203/373, 234/282, 287, 234/346/373, 287/292, 287/292/295/297, 287/292/297, 287/295/297, 287/330/333, 292, 292/297, 292/330/331, 292/330/331, 292/331, 292/331/349, 292/349, 295, 295/297/333, 297/328, 297/373, 328/333, 330, 330/331, 331, 331/349, 333, 346/373, and 373, wherein said positions are numbered with reference to SEQ ID NO: 256. In some embodiments, the engineered transglutaminases comprise a polypeptide sequence comprising a sequence having at least 90% sequence identity to SEQ ID NO:2, 6, 34, and/or 256. In some alternative embodiments, the engineered transglutaminases comprise a polypeptide sequence comprising a sequence having at least 95% sequence identity to SEQ ID NO:2, 6, 34, and/or 256. In yet some additional embodiments, the engineered transglutaminases comprise a polypeptide sequence set forth in SEQ ID NO:2, 6, 34, or 256. In yet some additional embodiments, the engineered transglutaminases comprise a polypeptide sequence encoding a variant provided in Table 8.1, 9.1, 9.2, 10.1, and/or 11.1. In some further embodiments, the engineered transglutaminase comprises a polypeptide sequence selected from the even-numbered sequences set from in SEQ ID NOS: 4 to 756.

The present invention also provides engineered polynucleotide sequences encoding the engineered transglutaminases provided herein. In some embodiments, the engineered polynucleotide sequences comprise polynucleotide sequences that are at least 85%, 90%, 91%, 92%, 93%, 94% 95%, 96%, 97%, 98%, 99% or more identical to a sequence selected from the odd-numbered sequences set forth in SEQ ID NOS: 3 to 755. The present invention also provides vectors comprising the engineered polynucleotide sequences provided herein. In some embodiments, the vectors further comprise at least one control sequence. The present invention also provides host cells comprising the vectors provided herein.

The present invention also provides methods for producing the engineered transglutaminases provided herein, comprising culturing a host cell under conditions that at least one engineered transglutaminase is produced by said host cell. In some embodiments, the host cell produces an engineered transglutaminase. In some embodiments, the methods further comprise the step of recovering said engineered transglutaminase produced by said host cell.

The present invention also provides engineered transglutaminases capable of modifying a free amine in insulin in the presence of a glutamine donor. In some embodiments, the engineered transglutaminases provided herein are capable of modifying a glutamine in insulin in the presence of a lysine donor.

The present invention also provides methods of modifying insulin comprising: providing insulin and at least one engineered transglutaminase provided herein, combining said insulin, glutamine, and at least one engineered transglutaminase under conditions such that said insulin is modified. The present invention also provides methods of modifying insulin comprising: providing insulin and at least one engineered transglutaminase provided herein, combining said insulin, lysine, and at least one engineered transglutaminase under conditions such that said insulin is modified.

DESCRIPTION OF THE INVENTION

The present invention provides engineered transglutaminase enzymes, polynucleotides encoding the enzymes, compositions comprising the enzymes, and methods of using the engineered transglutaminase enzymes.

The transglutaminase variants provided herein are engineered from the *Streptomyces mobaraensis* transglutaminase of SEQ ID NO:2, in which various modifications have been introduced to generate improved enzymatic properties as described in detail below.

For the descriptions provided herein, the use of the singular includes the plural (and vice versa) unless specifically stated otherwise. For instance, the singular forms "a", "an" and "the" include plural referents unless the context clearly indicates otherwise. Similarly, "comprise." "comprises," "comprising" "include," "includes," and "including" are interchangeable and not intended to be limiting.

It is to be further understood that where descriptions of various embodiments use the term "comprising," those skilled in the art would understand that in some specific instances, an embodiment can be alternatively described using language "consisting essentially of" or "consisting of."

Both the foregoing general description, including the drawings, and the following detailed description are exemplary and explanatory only and are not restrictive of this disclosure. Moreover, the section headings used herein are for organizational purposes only and not to be construed as limiting the subject matter described.

Definitions

As used herein, the following terms are intended to have the following meanings. In reference to the present disclosure, the technical and scientific terms used in the descriptions herein will have the meanings commonly understood by one of ordinary skill in the art, unless specifically defined otherwise. Accordingly, the following terms are intended to have the following meanings. In addition, all patents and publications, including all sequences disclosed within such patents and publications, referred to herein are expressly incorporated by reference.

Unless otherwise indicated, the practice of the present invention involves conventional techniques commonly used in molecular biology, fermentation, microbiology, and related fields, which are known to those of skill in the art. Unless defined otherwise herein, all technical and scientific terms used herein have the same meaning as commonly understood by one of ordinary skill in the art to which this invention belongs. Although any methods and materials similar or equivalent to those described herein can be used in the practice or testing of the present invention, the preferred methods and materials are described. Indeed, it is intended that the present invention not be limited to the particular methodology, protocols, and reagents described herein, as these may vary, depending upon the context in which they are used. The headings provided herein are not limitations of the various aspects or embodiments of the present invention that can be had by reference to the specification as a whole. Accordingly, the terms defined below are more fully defined by reference to the specification as a whole.

Nonetheless, in order to facilitate understanding of the present invention, a number of terms are defined below. Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

As used herein, the term "comprising" and its cognates are used in their inclusive sense (i.e., equivalent to the term "including" and its corresponding cognates).

As used herein and in the appended claims, the singular "a", "an" and "the" include the plural reference unless the context clearly dictates otherwise. Thus, for example, reference to a "host cell" includes a plurality of such host cells.

Unless otherwise indicated, nucleic acids are written left to right in 5' to 3' orientation and amino acid sequences are written left to right in amino to carboxy orientation, respectively.

As used herein, the terms "protein," "polypeptide," and "peptide" are used interchangeably herein to denote a polymer of at least two amino acids covalently linked by an amide bond, regardless of length or post-translational modification (e.g., glycosylation, phosphorylation, lipidation, myristilation, ubiquitination, etc.). Included within this definition are D- and L-amino acids, and mixtures of D- and L-amino acids.

As used herein, "polynucleotide" and "nucleic acid" refer to two or more nucleosides that are covalently linked together. The polynucleotide may be wholly comprised ribonucleosides (i.e., an RNA), wholly comprised of 2' deoxyribonucleotides (i.e., a DNA) or mixtures of ribo- and 2' deoxyribonucleosides. While the nucleosides will typically be linked together via standard phosphodiester linkages, the polynucleotides may include one or more non-standard linkages. The polynucleotide may be single-stranded or double-stranded, or may include both single-stranded regions and double-stranded regions. Moreover, while a polynucleotide will typically be composed of the naturally occurring encoding nucleobases (i.e., adenine, guanine, uracil, thymine, and cytosine), it may include one or more modified and/or synthetic nucleobases (e.g., inosine, xanthine, hypoxanthine, etc.). Preferably, such modified or synthetic nucleobases will be encoding nucleobases.

As used herein, "hybridization stringency" relates to hybridization conditions, such as washing conditions, in the hybridization of nucleic acids. Generally, hybridization reactions are performed under conditions of lower stringency, followed by washes of varying but higher stringency.

The term "moderately stringent hybridization" refers to conditions that permit target-DNA to bind a complementary nucleic acid that has about 60% identity, preferably about 75% identity, about 85% identity to the target DNA; with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature T, as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5: SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are known to those of skill in the art.

As used herein, "coding sequence" refers to that portion of a nucleic acid (e.g., a gene) that encodes an amino acid sequence of a protein.

As used herein, "codon optimized" refers to changes in the codons of the polynucleotide encoding a protein to those preferentially used in a particular organism such that the encoded protein is efficiently expressed in the organism of interest. In some embodiments, the polynucleotides encoding the transglutaminase enzymes may be codon optimized for optimal production from the host organism selected for expression. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the transglutaminase enzymes may be codon optimized for optimal production from the host organism selected for expression.

As used herein, "preferred, optimal, high codon usage bias codons" refers interchangeably to codons that are used at higher frequency in the protein coding regions than other codons that code for the same amino acid. The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. Codons whose frequency increases with the level of gene expression are typically optimal codons for expression. A variety of methods are known for determining the codon frequency (e.g, codon usage, relative synonymous codon usage) and codon preference in specific organisms, including multivariate analysis, for example, using cluster analysis or correspondence analysis, and the effective number of codons used in a gene (See e.g., GCG CodonPreference, Genetics Computer Group Wisconsin Package; CodonW, John Peden, University of Nottingham; McInerney, Bioinform., 14:372-73 [1998]; Stenico et al., Nucleic Acids Res., 222:437-46 [1994] and Wright. Gene 87:23-29 [1990]). Codon usage tables are available for a growing list of organisms (See e.g., Wada et al., Nucleic Acids Res., 20:2111-2118 [1992]; Nakamura et al., Nucl. Acids Res., 28:292 [2000]; Duret, et al., supra: Henaut and Danchin, "*Escherichia coli* and *Salmonella*." Neidhardt, et al. (eds.), ASM Press, Washington D.C., [1996], p. 2047-2066. The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (See e.g., Uberbacher, Meth. Enzymol., 266:259-281 [1996]; Tiwari et al., Comput. Appl. Biosci., 13:263-270 [1997]).

As used herein, "control sequence" is defined herein to include all components, which are necessary or advantageous for the expression of a polynucleotide and/or polypeptide of the present invention. Each control sequence may be native or foreign to the polynucleotide of interest. Such control sequences include, but are not limited to, a leader, polyadenylation sequence, propeptide sequence, promoter, signal peptide sequence, and transcription terminator.

As used herein, "operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

As used herein, "promoter sequence" refers to a nucleic acid sequence that is recognized by a host cell for expression of a polynucleotide of interest, such as a coding sequence. The control sequence may comprise an appropriate promoter sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

As used herein, "naturally occurring" and "wild-type" refers to the form found in nature. For example, a naturally occurring or wild-type polypeptide or polynucleotide sequence is a sequence present in an organism that can be isolated from a source in nature and which has not been intentionally modified by human manipulation.

As used herein, "non-naturally occurring," "engineered," and "recombinant" when used in the present disclosure with reference to (e.g., a cell, nucleic acid, or polypeptide), refers to a material, or a material corresponding to the natural or native form of the material, that has been modified in a manner that would not otherwise exist in nature. In some embodiments the material is identical to naturally occurring material, but is produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

As used herein, "percentage of sequence identity," "percent identity," and "percent identical" refer to comparisons between polynucleotide sequences or polypeptide sequences, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage is calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Determination of optimal alignment and percent sequence identity is performed using the BLAST and BLAST 2.0 algorithms (See e.g., Altschul et al., J. Mol. Biol. 215: 403-410 [1990] and Altschul et al., Nucl. Acids Res. 3389-3402 [1977]). Software for performing BLAST analyses is publicly available through the National Center for Biotechnology Information website.

Briefly, the BLAST analyses involve first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value: the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See e.g., Henikoff and Henikoff, Proc. Natl. Acad. Sci. USA 89:10915 [1989]).

Numerous other algorithms are available and known in the art that function similarly to BLAST in providing percent identity for two sequences. Optimal alignment of sequences for comparison can be conducted using any suitable method known in the art (e.g., by the local homology algorithm of Smith and Waterman, Adv. Appl. Math. 2:482 [1981]; by the homology alignment algorithm of Needleman and Wunsch, J. Mol. Biol. 48:443 [1970]; by the search for similarity method of Pearson and Lipman, Proc. Natl. Acad. Sci. USA 85:2444 [1988]; and/or by computerized implementations of these algorithms [GAP, BESTFIT, FASTA, and TFASTA in the GCG Wisconsin Software Package]), or by visual inspection, using methods commonly known in the art. Additionally, determination of sequence alignment and percent sequence identity can employ the BESTFIT or GAP programs in the GCG Wisconsin Software package (Accelrys, Madison Wis.), using the default parameters provided.

As used herein, "substantial identity" refers to a polynucleotide or polypeptide sequence that has at least 80 percent sequence identity, at least 85 percent identity and 89 to 95 percent sequence identity, more usually at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In specific embodiments applied to polypeptides, the term "substantial identity" means that two polypeptide sequences, when optimally aligned, such as by the programs GAP or BESTFIT using default gap weights, share at least 80 percent sequence identity, preferably at least 89 percent sequence identity, at least 95 percent sequence identity or more (e.g., 99 percent sequence identity). In some preferred embodiments, residue positions that are not identical differ by conservative amino acid substitutions.

As used herein, "reference sequence" refers to a defined sequence to which another sequence is compared. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides over a comparison window to identify and compare local regions of sequence similarity. The term "reference sequence" is not intended to be limited to wild-type sequences, and can include engineered or altered sequences. For example, in some embodiments, a "reference sequence" can be a previously engineered or altered amino acid sequence.

As used herein, "comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

As used herein, "corresponding to," "reference to," and "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered transglutaminase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned. As used herein, a reference to a residue position, such as "Xn" as further described below, is to be construed as referring to "a residue corresponding to", unless specifically denoted otherwise. Thus, for example, "X94" refers to any amino acid at position 94 in a polypeptide sequence.

As used herein, "improved enzyme property" refers to a transglutaminase that exhibits an improvement in any enzyme property as compared to a reference transglutaminase. For the engineered transglutaminase polypeptides described herein, the comparison is generally made to the wild-type transglutaminase enzyme, although in some embodiments, the reference transglutaminase is another improved engineered transglutaminase. Enzyme properties for which improvement is desirable include, but are not limited to, enzymatic activity (which can be expressed in terms of percent conversion of the substrate at a specified reaction time using a specified amount of transglutaminase), chemoselectivity, thermal stability, solvent stability, pH activity profile, cofactor requirements, refractoriness to inhibitors (e.g., product inhibition), stereospecificity, and stereoselectivity (including enantioselectivity).

As used herein, "increased enzymatic activity" refers to an improved property of the engineered transglutaminase polypeptides, which can be represented by an increase in specific activity (e.g., product produced/time/weight protein) or an increase in percent conversion of the substrate to the product (e.g., percent conversion of starting amount of substrate to product in a specified time period using a specified amount of transglutaminase) as compared to the reference transglutaminase enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.5 times the enzymatic activity of the corresponding wild-type transglutaminase enzyme, to as much as 2 times, 5 times, 10 times, 20 times, 25 times, 50 times, 75 times, 100 times, or more enzymatic activity than the naturally occurring transglutaminase or another engineered transglutaminase from which the transglutaminase polypeptides were derived. In specific embodiments, the engineered transglutaminase enzyme exhibits improved enzymatic activity in the range of 1.5 to 50 times, 1.5 to 100 times greater than that of the parent transglutaminase enzyme. It is understood by the skilled artisan that the activity of any enzyme is diffusion limited such that the catalytic turnover rate cannot exceed the diffusion rate of the substrate, including any required cofactors. The theoretical maximum of the diffusion limit, or $k_{cat}/K_m$, is generally about $10^8$ to $10^9$ ($M^{-1} s^{-1}$). Hence, any improvements in the enzyme activity of the transglutaminase will have an upper limit related to the diffusion rate of the substrates acted on by the transglutaminase enzyme.

Transglutaminase activity can be measured by any one of standard assays available in the art (e.g., hydroxymate assays). Comparisons of enzyme activities are made using a defined preparation of enzyme, a defined assay under a set condition, and one or more defined substrates, as further described in detail herein. Generally, when lysates are compared, the numbers of cells and the amount of protein assayed are determined as well as use of identical expression systems and identical host cells to minimize variations in amount of enzyme produced by the host cells and present in the lysates.

As used herein, "increased enzymatic activity" and "increased activity" refer to an improved property of an engineered enzyme, which can be represented by an increase in specific activity (e.g., product produced/time/weight protein) or an increase in percent conversion of the substrate to the product (e.g., percent conversion of starting amount of substrate to product in a specified time period using a specified amount of transglutaminase) as compared to a reference enzyme as described herein. Any property relating to enzyme activity may be affected, including the classical enzyme properties of $K_m$, $V_{max}$, or $k_{cat}$, changes of which can lead to increased enzymatic activity. Comparisons of enzyme activities are made using a defined preparation of enzyme, a defined assay under a set condition, and one or more defined substrates, as further described in detail herein. Generally, when enzymes in cell lysates are compared, the numbers of cells and the amount of protein assayed are determined as well as use of identical expression systems and identical host cells to minimize variations in amount of enzyme produced by the host cells and present in the lysates.

As used herein, "conversion" refers to the enzymatic transformation of a substrate to the corresponding product.

As used herein "percent conversion" refers to the percent of the substrate that is converted to the product within a period of time under specified conditions. Thus, for example, the "enzymatic activity" or "activity" of a transglutaminase polypeptide can be expressed as "percent conversion" of the substrate to the product.

As used herein, "chemoselectivity" refers to the preferential formation in a chemical or enzymatic reaction of one product over another.

As used herein, "thermostable" and "thermal stable" are used interchangeably to refer to a polypeptide that is resistant to inactivation when exposed to a set of temperature conditions (e.g., 40-80° C.) for a period of time (e.g., 0.5-24 hrs) compared to the untreated enzyme, thus retaining a certain level of residual activity (e.g., more than 60% to 80%) after exposure to elevated temperatures.

As used herein, "solvent stable" refers to the ability of a polypeptide to maintain similar activity (e.g., more than e.g., 60% to 80%) after exposure to varying concentrations (e.g., 5-99%) of solvent (e.g., isopropyl alcohol, tetrahydrofuran, 2-methyltetrahydrofuran, acetone, toluene, butylacetate, methyl tert-butylether, etc.) for a period of time (e.g., 0.5-24 hrs) compared to the untreated enzyme.

As used herein, "pH stable" refers to a transglutaminase polypeptide that maintains similar activity (e.g., more than 60% to 80%) after exposure to high or low pH (e.g., 4.5-6 or 8 to 12) for a period of time (e.g., 0.5-24 hrs) compared to the untreated enzyme.

As used herein, "thermo- and solvent stable" refers to a transglutaminase polypeptide that is both thermostable and solvent stable.

As used herein, "hydrophilic amino acid or residue" refers to an amino acid or residue having a side chain exhibiting a hydrophobicity of less than zero according to the normalized consensus hydrophobicity scale of Eisenberg et al., (Eisenberg et al., J. Mol. Biol., 179:125-142 [1984]). Genetically encoded hydrophilic amino acids include L-Thr (T), L-Ser (S), L-His (H), L-Glu (E), L-Asn (N), L-Gln (Q), L-Asp (D), L-Lys (K) and L-Arg (R).

As used herein, "acidic amino acid or residue" refers to a hydrophilic amino acid or residue having a side chain exhibiting a pK value of less than about 6 when the amino acid is included in a peptide or polypeptide. Acidic amino acids typically have negatively charged side chains at physiological pH due to loss of a hydrogen ion. Genetically encoded acidic amino acids include L-Glu (E) and L-Asp (D).

As used herein, "basic amino acid or residue" refers to a hydrophilic amino acid or residue having a side chain exhibiting a pK value of greater than about 6 when the amino acid is included in a peptide or polypeptide. Basic amino acids typically have positively charged side chains at physiological pH due to association with hydronium ion. Genetically encoded basic amino acids include L-Arg (R) and L-Lys (K).

As used herein, "polar amino acid or residue" refers to a hydrophilic amino acid or residue having a side chain that is uncharged at physiological pH, but which has at least one bond in which the pair of electrons shared in common by two atoms is held more closely by one of the atoms. Genetically encoded polar amino acids include L-Asn (N), L-Gln (Q), L-Ser (S) and L-Thr (T).

As used herein, "hydrophobic amino acid or residue" refers to an amino acid or residue having a side chain exhibiting a hydrophobicity of greater than zero according to the normalized consensus hydrophobicity scale of Eisenberg et al., (Eisenberg et al., J. Mol. Biol., 179:125-142 [1984]). Genetically encoded hydrophobic amino acids include L-Pro (P), L-Ile (I), L-Phe (F), L-Val (V), L-Leu (L), L-Trp (W), L-Met (M), L-Ala (A) and L-Tyr (Y).

As used herein, "aromatic amino acid or residue" refers to a hydrophilic or hydrophobic amino acid or residue having a side chain that includes at least one aromatic or heteroaromatic ring.

Genetically encoded aromatic amino acids include L-Phe (F), L-Tyr (Y) and L-Trp (W). Although owing to the pKa of its heteroaromatic nitrogen atom L-His (H) it is sometimes classified as a basic residue, or as an aromatic residue as its side chain includes a heteroaromatic ring, herein histidine is classified as a hydrophilic residue or as a "constrained residue" (see below).

As used herein, "constrained amino acid or residue" refers to an amino acid or residue that has a constrained geometry. Herein, constrained residues include L-Pro (P) and L-His (H). Histidine has a constrained geometry because it has a relatively small imidazole ring. Proline has a constrained geometry because it also has a five membered ring.

As used herein, "non-polar amino acid or residue" refers to a hydrophobic amino acid or residue having a side chain that is uncharged at physiological pH and which has bonds in which the pair of electrons shared in common by two atoms is generally held equally by each of the two atoms (i.e., the side chain is not polar). Genetically encoded non-polar amino acids include L-Gly (G), L-Leu (L), L-Val (V). L-Ile (I), L-Met (M) and L-Ala (A).

As used herein, "aliphatic amino acid or residue" refers to a hydrophobic amino acid or residue having an aliphatic hydrocarbon side chain. Genetically encoded aliphatic amino acids include L-Ala (A), L-Val (V), L-Leu (L) and L-Ile (I). It is noted that cysteine (or "L-Cys" or "[C]") is unusual in that it can form disulfide bridges with other L-Cys (C) amino acids or other sulfanyl- or sulfhydryl-containing amino acids. The "cysteine-like residues" include cysteine and other amino acids that contain sulfhydryl moieties that are available for formation of disulfide bridges. The ability of L-Cys (C) (and other amino acids with —SH containing side chains) to exist in a peptide in either the reduced free —SH or oxidized disulfide-bridged form affects whether L-Cys (C) contributes net hydrophobic or hydrophilic character to a peptide. While L-Cys (C) exhibits a hydrophobicity of 0.29 according to the normalized consensus scale of Eisenberg (Eisenberg et al., 1984, supra), it is to be understood that for purposes of the present disclosure, L-Cys (C) is categorized into its own unique group.

As used herein, "small amino acid or residue" refers to an amino acid or residue having a side chain that is composed of a total three or fewer carbon and/or heteroatoms (excluding the α-carbon and hydrogens). The small amino acids or residues may be further categorized as aliphatic, non-polar, polar or acidic small amino acids or residues, in accordance with the above definitions. Genetically-encoded small amino acids include L-Ala (A), L-Val (V), L-Cys (C), L-Asn (N), L-Ser (S), L-Thr (T) and L-Asp (D).

As used herein, "hydroxyl-containing amino acid or residue" refers to an amino acid containing a hydroxyl (—OH) moiety. Genetically-encoded hydroxyl-containing amino acids include L-Ser (S) L-Thr (T) and L-Tyr (Y).

As used herein, "amino acid difference" and "residue difference" refer to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X40 as compared to SEQ ID NO:2" refers to a difference of the amino acid residue at the polypeptide position corresponding to position 40 of SEQ ID NO:2. Thus, if the reference polypeptide of SEQ ID NO:2 has a histidine at position 40, then a "residue difference at position X40 as compared to SEQ ID NO:2" refers to an amino acid substitution of any residue other than histidine at the position of the polypeptide corresponding to position 40 of SEQ ID NO:2. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances, the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present disclosure can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X192A/G). The present disclosure includes engineered polypeptide sequences comprising one or more amino acid differences that include either/or both conservative and non-conservative amino acid substitutions. The amino acid sequences of the specific recombinant carbonic anhydrase polypeptides included in the Sequence Listing of the present disclosure include an initiating methionine (M) residue (i.e., M represents residue position 1). The skilled artisan, however, understands that this initiating methionine residue can be removed by biological processing machinery, such as in a host cell or in vitro translation system, to generate a mature protein lacking the initiating methionine residue, but otherwise retaining the enzyme's properties. Consequently, the term "amino acid residue difference relative to SEQ ID NO:2 at position Xn" as used herein may refer to position "Xn" or to the corresponding position (e.g. position (X−1)n) in a reference sequence that has been processed so as to lack the starting methionine.

As used herein, the phrase "conservative amino acid substitutions" refers to the interchangeability of residues having similar side chains, and thus typically involves substitution of the amino acid in the polypeptide with amino acids within the same or similar defined class of amino acids. By way of example and not limitation, in some embodiments, an amino acid with an aliphatic side chain is substituted with another aliphatic amino acid (e.g., alanine, valine, leucine, and isoleucine); an amino acid with a hydroxyl side chain is substituted with another amino acid with a hydroxyl side chain (e.g., serine and threonine); an amino acid having aromatic side chains is substituted with another amino acid having an aromatic side chain (e.g., phenylalanine, tyrosine, tryptophan, and histidine); an amino acid with a basic side chain is substituted with another amino acid with a basic side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively. Exemplary conservative substitutions are provided in Table 1.

TABLE 1

Exemplary Conservative Amino Acid Substitutions

| Residue | Potential Conservative Substitutions |
| --- | --- |
| A, L, V, I | Other aliphatic (A, L, V, I) |
| | Other non-polar (A, L, V, I, G, M) |
| G, M | Other non-polar (A, L, V, I, G, M) |
| D, E | Other acidic (D, E) |
| K, R | Other basic (K, R) |
| N, Q, S, T | Other polar |
| H, Y, W, F | Other aromatic (H, Y, W, F) |
| C, P | Non-polar |

As used herein, the phrase "non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

As used herein, "deletion" refers to modification of the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the polypeptide while retaining enzymatic activity and/or retaining the improved properties of an engineered enzyme. Deletions can be directed to the internal portions and/or terminal portions of the polypeptide. In various embodiments, the deletion can comprise a continuous segment or can be discontinuous.

As used herein, "insertion" refers to modification of the polypeptide by addition of one or more amino acids to the reference polypeptide. In some embodiments, the improved engineered transglutaminase enzymes comprise insertions of one or more amino acids to the naturally occurring transglutaminase polypeptide as well as insertions of one or more amino acids to engineered transglutaminase polypeptides. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

The term "amino acid substitution set" or "substitution set" refers to a group of amino acid substitutions in a polypeptide sequence, as compared to a reference sequence. A substitution set can have 1, 2, 3, 4, 5, 6, 7, 8, 9, 10, 11, 12, 13, 14, 15, or more amino acid substitutions. In some embodiments, a substitution set refers to the set of amino acid substitutions that is present in any of the variant transglutaminases listed in the Tables provided in the Examples.

As used herein, "fragment" refers to a polypeptide that has an amino-terminal and/or carboxy-terminal deletion, but where the remaining amino acid sequence is identical to the corresponding positions in the sequence. Fragments can typically have about 80%, about 90%, about 95%0 about 98%, or about 99% of the full-length transglutaminase polypeptide, for example the polypeptide of SEQ ID NO:2. In some embodiments, the fragment is "biologically active" (i.e., it exhibits the same enzymatic activity as the full-length sequence).

As used herein, "isolated polypeptide" refers to a polypeptide that is substantially separated from other contaminants that naturally accompany it (e.g., proteins, lipids, and polynucleotides). The term embraces polypeptides which have been removed or purified from their naturally-occurring environment or expression system (e.g., host cell or in vitro synthesis). The improved transglutaminase enzymes may be present within a cell, present in the cellular medium, or prepared in various forms, such as lysates or isolated preparations. As such, in some embodiments, the engineered transglutaminase polypeptides of the present disclosure can be an isolated polypeptide.

As used herein, "substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure engineered transglutaminase polypeptide composition comprises about 60% or more, about 70% or more, about 80% or more, about 90% or more, about 91% or more, about 92% or more, about 93% or more, about 94% or more, about 95% or more, about 96% or more, about 97% or more, about 98% or more, or about 99% of all macromolecular species by mole or % weight present in the composition. Solvent species, small molecules (<500 Daltons), and elemental ion species are not considered macromolecular species. In some embodiments, the isolated improved transglutaminase polypeptide is a substantially pure polypeptide composition.

As used herein, when used in reference to a nucleic acid or polypeptide, the term "heterologous" refers to a sequence that is not normally expressed and secreted by an organism (e.g., a wild-type organism). In some embodiments, the term encompasses a sequence that comprises two or more subsequences which are not found in the same relationship to each other as normally found in nature, or is recombinantly engineered so that its level of expression, or physical relationship to other nucleic acids or other molecules in a cell, or structure, is not normally found in nature. For instance, a heterologous nucleic acid is typically recombinantly produced, having two or more sequences from unrelated genes arranged in a manner not found in nature (e.g., a nucleic acid open reading frame (ORF) of the invention operatively linked to a promoter sequence inserted into an expression cassette, such as a vector). In some embodiments, "heterologous polynucleotide" refers to any polynucleotide that is introduced into a host cell by laboratory techniques, and includes polynucleotides that are removed from a host cell, subjected to laboratory manipulation, and then reintroduced into a host cell.

As used herein, "suitable reaction conditions" refer to those conditions in the biocatalytic reaction solution (e.g., ranges of enzyme loading, substrate loading, cofactor loading, temperature, pH, buffers, co-solvents, etc.) under which a transglutaminase polypeptide of the present disclosure is capable of modifying a substrate of interest. In some embodiments, the transglutaminases cross-link substituted glutamines and substituted lysines in various substrates, including low molecular weight substrates and proteins. In some embodiments, the transglutaminases of the present invention are capable of site specific modification of biological macromolecules. Exemplary "suitable reaction conditions" are provided in the present disclosure and illustrated by the Examples.

As used herein, "loading," such as in "compound loading," "enzyme loading," or "cofactor loading" refers to the concentration or amount of a component in a reaction mixture at the start of the reaction.

As used herein, "substrate" in the context of a biocatalyst mediated process refers to the compound or molecule acted on by the biocatalyst.

As used herein "product" in the context of a biocatalyst mediated process refers to the compound or molecule resulting from the action of the biocatalyst.

As used herein, "equilibration" as used herein refers to the process resulting in a steady state concentration of chemical species in a chemical or enzymatic reaction (e.g., interconversion of two species A and B), including interconversion of stereoisomers, as determined by the forward rate constant and the reverse rate constant of the chemical or enzymatic reaction.

As used herein, "transglutaminase," "TG," "TGase," and "polypeptide with transglutaminase activity," refer to an enzyme having the ability to catalyze the acyl transfer reaction between the gamma-carboxyamide group in a peptide/protein (e.g., glutamine residues) and various primary amines, which act as amine donors. In some embodiments, there is a substitution reaction of glutamine with glutamic acid by the deamidation of glutamic acid. In some embodiments, lysine is used as the acyl acceptor, which results in the enrichment of the protein molecule used in the reaction. The transfer of acyl onto a lysine residue in a polypeptide chain induces the cross-linking process (i.e., the formation of intra- or inter-molecular cross-links (See e.g., Kieliszek and Misiewicz, supra, and Kashiwagi et al., J. Biol. Chem., 277:44252-44260 [2002]). In some embodiments, transglutaminases find use in catalyzing deamination reactions in the absence of free amine groups, but the presence of water, which acts as an acyl acceptor. This results in significant changes in the physical and chemical properties of affected proteins, including modifications in viscosity, thermostability, elasticity, and resilience (See e.g., Kieliszek and Misiewicz, supra; Motoki and Seguroa, Trends Food Sci. Technol., 9:204-210 [1998]; and Kuraishi et al., Food Rev. Intl., 17:221-246 [2001]). Transglutaminases are known to be widely distributed in various organisms, including humans, bacteria, nematodes, yeasts, algae, plants, and lower vertebrates (See e.g., Santos and Tome, Recent Pat. Biotechnol., 3:166-174 [2009]).

As used herein, "transglutamination," "transamination," and "transglutaminase reaction" refer to reactions in which the gamma-glutaminyl of glutamine residue from a protein/polypeptide/peptide is transferred to a primary amine or the episilon-amino group of lysine or water, wherein an ammonia molecule is released.

As used herein, "derived from" when used in the context of engineered transglutaminase enzymes, identifies the originating transglutaminase enzyme, and/or the gene encoding such transglutaminase enzyme, upon which the engineering was based. For example, the engineered transglutaminase enzyme of SEQ ID NO: 296 was obtained by artificially evolving, over multiple generations the gene (SEQ ID NO: 1) encoding the *S. mobaraensis* transglutaminase of SEQ ID NO:2.

Thus, this engineered transglutaminase enzyme is "derived from" the naturally occurring or wild-type transglutaminase of SEQ ID NO: 2.

Transglutaminases

The present invention provides variant transglutaminases developed from a wild-type *S. mobaraensis* transglutaminase enzyme. *S. mobaraensis* is also classified as *Streptoverticillium mobaraese*. This enzyme has a molecular weight of about 38 kDa and is calcium independent (See e.g., Appl. Microbiol. Biotech., 64:447-454 [2004]: and US Pat. Appln. Publ. No. 2010/0099610, incorporated herein by reference).

Transglutaminases have found use in altering the properties of various peptides. In some embodiments, the enzyme is used to cross-bind peptides useful in the food and dairy industries, as well as in uses involving physiologically active peptides, biomedicine, biomaterials, antibodies, the textile industry (e.g., wool and leather), methods for peptide conjugation, linkage of agents to tissue, cosmetics, etc. (See e.g., EP 950 665. EP 785 276, WO 2005/070468, WO 2006/134148, WO 2008/102007, WO 2009/003732, U.S. Pat. No. 6,013,498, US Pat. Appln. Publ. No. 2010/0099610: US Pat. Appln. Publ. No. 2010/0249029; and US Pat. Appln. Publ. No. 2010/0087371, each of which is incorporated by reference herein; and Sato, Adv. Drug Deliv. Rev., 54:487-504 [2002]; Valdivia, J. Biotechnol., 122:326-333 [2006]; Wada, Biotech. Lett., 23:1367-1372 [2001]; Kieliszek and Misiewicz, Folia Microbiol., 59:241-250 [2014]; Yokoyama et al., Appl. Microbiol. Biotechol., 64:447454 [2004]; Washizu et al., Biosci. Biotech. Biochem., 58:82-87 [1994]; Kanaji et al., J. Biol. Chem., 268:11565-11572 [1993]; Ando et al., Agric. Biol. Chem. 53:2613-2617 [1989]; Martins et al., Appl. Microbiol. Biotechnol., 98:6957-6964 [2014]; Jerger et al., Angew. Chem. Int., 49:9995-9997 [2010]; Grunberg et al., PLoS ONE 8:e60350 [2013]: Mindt et al., Bioconj. Chem., 19:271-278 [2008]: Lhospice et al., Mol. Pharmaceutics 12:1863-1871 [2015]; Dennler et al., Bioconj. Chem., 25:569-578 [2014]; and Santos and Tome, Rec. Patents Biotechnol., 3:166-174 [2009], for discussion of transglutaminases, their sources, and uses). These enzymes are capable of improving the firmness, viscosity, elasticity, and water-binding capacity of food and other products.

In some embodiments, the transglutaminase variants provided herein find use in the food industry for production of foods (e.g., jelly, yogurt, cheese, noodles, chewing gum, candy, baked products, soybean protein, gummy candy, snacks, pickles, meat, and chocolate), while in some other embodiments, the transglutaminase variants find use in other industries (e.g., textiles, pharmaceuticals, diagnostics, etc.).

In some embodiments, the present invention provides engineered transglutaminase polypeptides with amino acid sequences that have at least about 85%, 86%, 87%, 88%, 89%, 90%, 91%, 92%, 93%, 94%, 95%, 96%, 97%, 98%, or 99% or more sequence identity to SEQ ID NO: 2, 6, 34, and/or 256.

In some embodiments, the engineered transglutaminase polypeptides comprise substitutions at one or more positions selected from 79, 101, 101/201/212/287, 101/201/285, 101/287, and 327, wherein the positions are numbered with reference to SEQ ID NO:6. In some embodiments, the engineered transglutaminase polypeptides comprise one or more substitutions selected from 79K, 101G, 101G/201K/212K/287G, 101G/201K/285Q, 101G/287G, and 327R, wherein the positions are numbered with reference to SEQ ID NO:6. In some embodiments, the engineered transglutaminase polypeptides comprise one or more substitutions selected from S79K, Y101G, Y101G/Q201K/R212K/

S287G, Y101G/Q201K/R285Q, Y101G/S287G, and G327R, wherein the positions are numbered with reference to SEQ ID NO:6.

In some embodiments, the engineered transglutaminase polypeptides comprise substitutions at one or more positions selected from 48, 48/67/70, 48/67/70/181/203/256, 48/67/70/181/256/345, 48/67/70/181/296/345/373, 48/67/70/203/256/296/345, 48/67/70/203/256/345/354/373, 48/67/70/203/345, 48/67/70/256, 48/67/70/256/296/345/373, 48/67/203/256/296/373, 48/67/203/256/345, 48/70/170/203, 48/70/203/254/296/343, 48/70/203/256/345/373, 48/70/203/256/345, 48/70/203/373, 48/170/203, 48/170/203/254/296/346, 48/170/203/254/296/346/373, 48/170/203/254/346/373, 48/170/203/254/346, 48/170/203/296/343/346, 48/170/203/296/346/373, 48/170/203/343/346, 48/170/203/346, 48/170/203/346/373, 48/170/203/373, 48/170/254, 48/170/296, 48/170/296/343/346, 48/170/343/346, 48/181, 48/181/203/256/345, 48/181/203/345, 48/181/256/296/345, 48/181/296, 48/181/296/345, 48/203, 48/203/254/296, 48/203/254/296/343/373, 48/203/254/296/346/373, 48/203/254/346, 48/203/254/346/373, 48/203/256, 48/203/256/296/345, 48/203/296/343/346/373, 48/203/296/343/373, 48/203/296/346, 48/203/296/346/373, 48/203/343/346, 48/203/343/346/373, 48/203/345, 48/203/346, 48/203/346/373, 48/254/296, 48/254/346, 48/256, 48/256/296, 48/256/296/345, 48/296/345, 48/296/373, 48/343/346, 48/345/373, 67/256, 67/296/345, 68/74/190/215/346, 68/136/215/255/282/297/346, 68/136/215/297/346, 68/136/234, 68/158/174/234/282/297/346, 68/158/215/297/346, 68/215/297/346, 68/234, 68/282/297/346, 68/297/346, 74/136/174/282/346, 74/136/174/297/346, 74/136/346, 74/158/255/297, 74/255/346, 74/346, 136/158/190/215/255/297/346, 136/158/215/297/346, 136/174/215/255/282/297/346, 136/190/215/297/346, 136/215/234/282/297, 136/215/234/297/346, 136/215/297, 136/297/346, 158/215/255/346, 158/215/346, 170/203/254/296/343/346, 170/203/254/343/373, 170/203/343/346, 174/190/234/297/346, 174/215/234/297/346, 174/215/255/297/346, 174/282/297/346, 190/255/282/346, 190/297/346, 203/296, 203/343, 203/343/346, 203/346, 215/255/297/346, 215/234/297/346, 215/255/297/346, 215/297, 215/297/346, 215/346, 234/255/346, 255/297/346, 255/346, 297/346, 343/346/373, and 346, wherein the positions are numbered with reference to SEQ ID NO:2. In some embodiments, the engineered transglutaminase polypeptides comprise one or more substitutions selected from 48K/70L/203L/254Q/296L/343R, 48K/170K/203L, 48K/I 70K/203L/254Q/296L/346H, 48K/I 70K/203L/254Q/296L/346H/373M, 48K/170K/203L/254Q/346H/373M, 48K/170K/203L/254Q/346H, 48K/170K/203L/296L/343R/346H, 48K/170K/203L/296L/346H/373M, 48K/170K/203L/343R/346H, 48K/170K/203L/346H/373M, 48K/170K/203L/346H, 48K/170K/203L/373M, 48K/170K/254Q, 48K/170K/296L, 48K/170K/296L/343R/346H, 48K/170K/343R/346H, 48K/203L, 48K/203L/254Q/296L, 48K/203L/254Q/296L/343R/373M, 48K/203L/254Q/296L/346H/373M, 48K/203L/254Q/346H, 48K/203L/254Q/346H/373M, 48K/203L/296L/343R/346H/373M 48K/203L/296L/343R/373M, 48K/203L/296L/346H, 48K/203L/296L/346H/373M, 48K/203L/343R/346H, 48K/203L/343R/346H/373M, 48K/203L/346H, 48K/203L/346H/373M, 48K/254Q/346H, 48K/343R/346H, 48V, 48V/67E/70G, 48V/67E/70G/181K/203V/256G, 48V/67E/70G/181K/256G/345E, 48V/67E/70G/181K/296R/345E/373V, 48V/67E/70G/203V/256G/296R/345E, 48V/67E/70G/203V/345E, 48V/67E/70G/256G/296R/345E/373V, 48V/67E/70N/203V/256G/345E/354H/373L, 48V/67E/70N/256G, 48V/67E/203V/256G/296R/373V, 48V/67E/203V/256G/345E, 48V/70D/170K/203L, 48V/70G/203V/256G/345E/373V, 48V/70N/203V/256G/345E, 48V/70N/203V/373V, 48V/181K, 48V/181K/203V/256G/345E, 48V/181K/203V/345E, 48V/181K/256G/296R/345E, 48V/181K/296R, 48V/181K/203V/345E, 48V/181K/256G/296R/345E, 48V/181K/296R/345E, 48V/203V, 48V/203V/256G, 48V/203V/256G/296R/345E, 48V/203V/345E, 48K/254Q/296L, 48V/256G, 48V/256G/296R, 48V/256G/296R/345E, 48V/296R/345E, 48V/296R/373V, 48V/345E/373L, 67E/256G, 67E/296R/345E, 68A/74T/190G/215N/346A, 68A/136Y/215N/255R/282K/297W/346A, 68A/136Y/215N/297W/346A, 68A/136Y/234Y, 68A/158I/174D/234Y/282K/297W/346A, 68A/158I/215N/297W/346A, 68A/215N/297W/346A, 68A/234Y, 68A/282K/297W/346A, 68A/297W/346A, 74T/136Y/174D/282K/346A, 74T/136Y/174D/297W/346A, 74T/136Y/346A, 74T/158I/255R/297W, 74T/255R/346A, 74T/346A, 136Y/158I/190G/215N/255R/297W/346A, 136Y/158I/215N/297W/346A, 136Y/174D/215N/255R/282K/297W/346A, 136Y/190G/215N/297W/346A, 136Y/215N/234Y/282K/297W, 136Y/215N/234Y/297W/346A, 136Y/215N/297W, 136Y/297W/346A, 158I/215N/255R/346A, 158I/215N/346A, 170K/203L/254Q/296L/343R/346H, 170K/203L/254Q/343R/373M, 170K/203L/343R/346H, I 74D/190G/234Y/297W/346A, 174D/215N/234Y/297W/346A, 174D/215N/255R/297W/346A, 174D/282K/297W/346A, 190G/255R/282K/346A, 190G/297W/346A, 203L/296L, 203L/343R/346H, 203L/343R, 203L/346H, 215H/255R/297W/346A, 215N/234Y/297W/346A, 215N/255R/297W/346A, 215N/297W, 215N/297W/346A, 215N/346A, 234Y/255R/346A, 255R/297W/346A, 255R/346A, 297W/346A, 343R/346H/373M, and 346A, wherein the positions are numbered with reference to SEQ ID NO:2.

In some embodiments, the engineered transglutaminase polypeptides comprise one or more substitutions selected from S48K/Y70L/G203L/R254Q/G296U/N343R, S48K/Q170K/G203L, S48K/Q170K/G203L/R254Q/G296L/E346H, S48K/Q170K/G203L/R254Q/G296L/E346H/K373M, S48K/Q170K/G203L/R254Q/E346H/K373M, S48K/Q170K/G203U/R254Q/E346H, S48K/Q170K/G203L/G296L/N343R/E346H, S48K/Q170K/G203L/G296L/E346H/K373M, S48K/Q170K/G203L/N343R/E346H, S48K/Q170K/G203L/E346H/K373M, S48K/Q170K/G203L/E346H, S48K/Q170K/G203L/K373M, S48K/Q170K/R254Q, S48K/Q170K/G296L, S48K/Q170K/G296L/N343R/E346H, S48K/Q170K/N343R/E346H, S48K/G203L, S48K/G203L/R254Q/G296L, S48K/G203L/R254Q/G296L/N343R/K373M, S48K/G203L/R254Q/G296L/E346H/K373M, S48K/G203L/R254Q/E346H, S48K/G203L/R254Q/E346H/K373M, S48K/G203L/G296L/N343R/E346H/K373M, S48K/G203L/G296L/N343R/K373M, S48K/G203L/G296L/E346H, S48K/G203L/G296L/E346H/K373M, S48K/G203L/N343R/E346H, S48K/G203L/N343R/E346H/K373M, S48K/G203L/E346H, S48K/G203L/E346H/K373M, S48K/R254Q/E346H, S48K/N343R/E346H, S48V, S48V/R67E/Y70G, S48V/R67E/Y70G/R181K/G203V/S256G, S48V/R67E/Y70G/R181K/S256G/S345E, S48V/R67E/Y70G/R181K/G296R/S345E/K373V, S48V/R67E/Y70G/G203V/S256G/G296R/S345E, S48V/R67E/Y70G/G203V/S345E, S48V/R67E/Y70G/S256G/G296R/S345E/K373V, S48V/R67E/Y70N/G203V/S256/S345E/G354H/K373L, S48V/R67E/Y70N/S256G, S48V/R67E/G203V/S256G/G296R/K373V, S48V/R67E/G203V/S256G/S345E, S48K/Y70D/Q170K/G203L, S48V/Y70G/G203V/S256G/S345E/K373V, S48V/Y70N/G203V/S256G/S345E, S48V/Y70N/G203V/K373V, S48V/R181K, S48V/R181K/G203V/S256G/S345E, S48V/R181K/G203V/S345E, S48V/R181K/S256G/G296R/S345E, S48V/R181G296R, S48V/R181K/

G296R/S345E, S48V/G203V, S48V/G203V/S256G, S48V/ G203V/S256G/G296R/S345E, S48V/G203V/S345E, S48K/R254Q/G296L, S48V/S256G, S48V/S256G/G296R, S48V/S256G/G296R/S345E, S48V/G296R/S345E, S48V/ G296R/K373V, S48V/S345E/K373L, R67E/S256G, R67E/ G296R/S345E, P68A/E74T/S190G/P215N/E346A, P68A/ F136Y/P215N/S255R/R282K/F297W/E346A, P68A/ F136Y/P215N/F297W/E346A, P68A/F136Y/H234Y, P68A/V158I/E174D/H234Y/R282K/F297W/E346A, P68A/V158I/P215N/F297W/E346A, P68A/P215N/F297W/ E346A, P68A/H234Y, P68A/R282K/F297W/E346A, P68A/ F297W/E346A, E74T/F136Y/E174D/R282K/E346A, E74T/F136Y/E174D/F297W/E346A, E74T/F136Y/E346A, E74T/V158I/S255R/F297W, E74T/S255R/E346A, E74T/ E346A, F136Y/V158I/S190G/P215N/S255R/F297W/ E346A, F136Y/V158I/P215N/F297W/E346A, F136Y/ E174D/P215N/S255R/R282K/F297W/E346A, F136Y/ S190G/P215N/F297W/E346A, F136Y/P215N/H234Y/ R282K/F297W, F136Y/P215N/H234Y/F297W/E346A, F136Y/P215N/F297W, F136Y/F297W/E346A, V158I/ P215N/S255R/E346A, V158I/P215N/E346A, Q170K/ G203L/R254Q/G296L/N343R/E346H, Q170K/G203L/ R254Q/N343R/K373M, Q170K/G203L/N343R/E346H, E174D/S190G/H234Y/F297W/E346A, E174D/P215N/ H234Y/F297W/E346A, E174D/P215N/S255R/F297W/ E346A, E174D/R282K/F297W/E346A, S190G/S255R/ R282K/E346A, S190G/F297W/E346A, G203L/G296L, G203L/N343R/E346H, G203L/N343R, G203L/E346H, P215H/S255R/F297W/E346A, P215N/H234Y/F297W/ E346A, P215N/S255R/F297W/E346A, P215N/F297W, P215N/F297W/E346A, P215N/E346A, H234Y/S255R/ E346A, S255R/F297W/E346A, S255R/E346A, F297W/ E346A, N343R/E346H/K373M, and E346A, wherein the positions are numbered with reference to SEQ ID NO:2.

In some embodiments, the engineered transglutaminase polypeptides comprise substitutions at one or more positions selected from 33/67/70/181/203/256/296/373, 36/48/203/ 254/346, 48/67/70/181/203/256/296/373, 48/67/70/203/ 256/296/373, 48/67/181/203/256/296/373, 48/67/181/203/ 256/373, 48/67/181/256/296, 48/67/203/256/296/373/378, 48/67/203/256/373, 48/67/203/296/373, 48/67/256/296/373, 48/70/181/203/256/296/373, 48/70/181/203/256/373, 48/70/181/203/296/373, 48/70/203/256/296/373, 48/70/ 203/256/373, 48/70/203/296, 48/70/203/296/373, 48/70/ 203/373, 48/70/256/296/373, 48/70/296/373, 48/176/203/ 254/346/373, 48/181/203/256/296/373, 48/181/203/256/ 373, 48/181/203/296, 48/181/203/373, 48/181/256/296/373, 48/203/254, 48/203/254/343, 48/203/254/343/346/373, 48/203/254/343/355/373, 48/203/254/343/373, 48/203/254/ 346/373, 48/203/254/373, 48/203/256/296, 48/203/256/296/ 373, 48/203/256/373, 48/203/296/373, 48/203/296/373/374, 48/203/343/373, 48/203/373, 48/254, 48/254/343/346/373, 48/254/343/373, 48/254/346/373, 48/254/373, 48/256/296/ 373, 48/256/373, 48/373, 67/70/181/203/256/296/373, 67/70/181/256/296/373, 67/70/181/373, 67/181/203/256/ 296, 67/181/203/256/296/373, 67/181/203/256/373, 67/203/ 256/296/373, 67/256/296/373, 70/181/203/256/296/373, 70/181/203/256/296/373, 70/203, 70/203/256/296/373, 70/203/ 256/373, 70/203/296/373, 74/136/215/234/282/297/346, 74/136/215/234/282/346, 74/136/215/234/297, 74/136/215/ 234/297/343/346, 74/136/215/234/297/346, 74/136/215/ 234/346, 74/136/215/282/297/346, 74/136/215/282/346, 74/136/215/297/346, 74/136/215/346, 74/136/234/282/297/ 346, 74/136/234/346, 74/136/282/297/346, 74/215, 74/215/ 234/282/297/346, 74/215/282/297/346, 74/215/346, 136/ 215/234/282/297/346, 136/215/282/297, 136/215/282/297/ 346, 136/215/282/346, 136/215/297/346, 136/215/346, 136/ 234/297, 136/234/297/346, 136/234/346, 136/282/297, 181/ 203/256, 181/203/256/296, 181/203/256/296/373, 181/203/ 256/373, 181/203/296/373, 181/203/373, 181/256/296/373, 181/296, 203/224/254/373, 203/254, 203/254/343/346/373, 203/254/343/373, 203/254/346, 203/254/346/373, 203/254/ 373, 203/346/373, 203/373, 203/209/256/373, 203/256, 203/ 256/296, 203/256/296/320/373, 203/256/296/373, 203/256/ 296/373/386, 203/256/373, 203/296/373, 203/373, 215/234/ 282/297/346, 215/234/282/346, 215/234/346, 234/282/346, 254, 254/346, 254/346/373, 254/373, 256/296, 256/296/373, 256/373, 282/297/346, 343/373, and 373, wherein the positions are numbered with reference to SEQ ID NO:2.

In some embodiments, the engineered transglutaminase polypeptides comprise one or more substitutions selected from 33D/67E/70G/181K/203V/256G/296R/373V, 36E/ 48K/203L/254Q/346H, 48K/176T/203L/254Q/346H/373M, 48K/203L/254Q, 48K/203L/254Q/343R, 48K/203L/254Q/ 343R/346H/373M, 48K/203L/254Q/343R/355T/373M, 48K/203L/254Q/343R/373M, 48K/203L/254Q/346D/ 373M, 48K/203L/254Q/373M, 48K/203L/343R/373M, 48K/203L/373M, 48K/254Q, 48K/254Q/343R/346H/373M, 48K/254Q/343R/373M, 48K/254Q/346H/373M, 48K/ 254Q/373M, 48V/67E/70G/181K/203V/256G/296R/373V, 48V/67E/70G/203V/256G/296R/373V, 48V/67E/181K/ 203V/256G/296R/373V, 48V/67E/181K/203V/256G/373V, 48V/67E/181K/256G/296R, 48V/67E/203V/256G/296R/ 373V/378D, 48V/67E/203V/256G/373V, 48V/67E/203V/ 296R/373V, 48V/67E/256G/296R/373V, 48V/70G/181K/ 203V/256G/296R/373V, 48V/70G/181K/203V/256G/373V, 48V/70G/181K/203V/296R/373V, 48V/70G/203V/256G/ 296R/373V, 48V/70G/203V/256G/373V, 48V/70G/203V/ 296R, 48V/70G/203V/296R/373V, 48V/70G/203V/373V, 48V/70G/256G/296R/373V, 48V/70G/296R/373V, 48V/ 181K/203V/256G/296R/373V, 48V/181K/203V/256G/ 373V, 48V/181K/203V/296R, 48V/181K/203V/373V, 48V/ 181K/256G/296R/373V, 48V/203V/256G/296R, 48V/ 203V/256G/296R/373V, 48V/203V/256G/373V, 48V/ 203V/296R/373V, 48V/203V/296R/373V/374L, 48V/203V/ 373V, 48V/256G/296R/373V, 48V/256G/373V, 48V/373V, 67E/70G/181K/203V/256G/296R/373V, 67E/70G/181K/ 256G/296R/373V, 67E/70G/181K/373V, 67E/181K/203V/ 256G/296R, 67E/181K/203V/256G/296R/373V, 67E/181K/ 203V/256G/373V, 67E/203V/256G/296R/373V, 67E/256G/ 296R/373V, 70G/181K/203V/256G/296R/373V, 70G/ 181K1203V/296R/373V, 70G/203V, 70G/203V/256G/ 296R/373V, 70G/203V/256G/373V, 70G/203V/296R/373V, 74T/136Y/215N/234Y/282K/297W/346A, 74T/136Y/ 215N/234Y/282K/346A, 74T/136Y/215N/234Y/297W, 74T/136Y/215N/234Y/297W/343Y/346A, 74T/136Y/ 215N/234Y/297W/346A, 74T/136Y/215N/234Y/346A, 74T/136Y/215N/282K/297W/346A, 74T/136Y/215N/ 282K/346A, 74T/136Y/215N/297W/346A, 74T/136Y/ 215N/346A, 74T/136Y/234Y/282K/297V/346A, 74T/ 136Y/234Y/346A, 74T/136Y/282K/297W/346A, 74T/ 215N, 74T/215N/234Y/282K/297W/346A, 74T/215N/ 282K/297W/346A, 74T/215N/346A, 136Y/215N/234Y/ 282K/297W/346A, 136Y/215N/282K/297W, 136Y/215N/ 282K/297W/346A, 136Y/215N/282K/346A, 136Y/215N/ 297W/346A, 136Y/215N/346A, 136Y/234Y/297W, 136Y/ 234Y/297W/346A, 136Y/234Y/346A, 136Y/282K/297W, 181K/203V/256G, 181K/203V/256G/296R, 181K/203V/ 2566/296R/373V, 181K1203V/256G/373V, 181K/203V/ 296R/373V, 181K/203V/373V, 181K/256G/296R/373V, 181K/296R, 203L/224T/254Q/373V, 203L/254Q, 203L/ 254Q/343R/346H/373M, 203L/254Q/343R/373M, 203L/ 254Q/346H, 203L/254Q/346H/373M, 203L/254Q/373M, 203L/346H/373M, 203L/373M, 203V/209Y/256G/373V, 203V/256G, 203V/256G/296R, 203V/256G/296R/320Y/ 373V, 203V/256G/296R/373V, 203V/256G/296R/373V/ 386Y, 203V/256G/373V, 203V/296R/373V, 203V/373V, 215N/234Y/282K/297W/346A, 215N/234Y/282K/346A, 215N1234Y/346A, 234Y/282K/346A, 254Q, 254Q/346H, 254Q/346H/373M, 254Q/373M, 256G/296R, 256G/296R/ 373V, 256G/373V, 282K/297W/346A, 343R/373M, and 373M/V, wherein the positions are numbered with reference to SEQ ID NO:2. In some embodiments, the engineered transglutaminase polypeptides comprise one or more substitutions selected from A33D/R67E/Y70G/R181K/G2βV/ S256G/G296R/K373V, A36E/S48K/G203L/R254Q/E346H, S48K/A176T/G203L/R254Q/E346H/K373M, S48K/ G203U/R254Q, S48K/G203L/R254Q/N343R, S48K/ G203L/R254Q/N343R/E346H/K373M, S48K/G203L/ R254Q/N343R/A355T/K373M, S48K/G203L/R254Q/ N343R/K373M, S48K/G203L/R254Q/E346D/K373M, S48K/G203L/R254Q/K373M, S48K/G203L/N343R/ K373M, S48K/G203L/K373M, S48K/R254Q, S48K/ R254Q/N343R/E346H/K373M, S48K/R254Q/N343R/ K373M, S48K/R254Q/E346H/K373M, S48K/R254Q/ K373M, S48V/R67E/Y70G/R181K/G203V/S256G/ G296R/K373V, S48V/R67E/Y70G/G203V/S256G/G296R/ K373V, S48V/R67E/R181K/G203V/S256G/G296R/ K373V, S48V/R67E/R181K/G203V/S256G/K373V, S48V/ R67E/R181K/S256G/G296R, S48V/R67E/G203V/S256G/ G296R/K373V/G378D, S48V/R67E/G203V/S256G/ K373V, S48V/R67E/G203V/G296R/K373V, S48V/R67E/ S256G/G296R/K373V, S48V/Y70G/R181K/G203V/ S256G/G296R/K373V, S48V/Y70G/R181K/G203V/ S256G/K373V, S48V/Y70G/R181K/G203V/G296R/ K373V, S48V/Y70G/G203V/S256/G296R/K373V, S48V/ Y70G/G203V/S256G/K373V, S48V/Y70G/G203V/G296R, S48V/Y70G203V/G296R/K373V, S48V/Y70G/G203V/ K373V, S48V/Y70/S256G/G296R/K373V, S48V/Y70G/ G296R/K373V, S48V/R181K/G203V/S256G/G296R/ K373V, S48V/R181K/G203V/S256G/K373V, S48V/ R181K/G203V/G296R, S48V/R181K/G203V/K373V, S48V/R181K/S256G/G296R/K373V, S48V/G203V/ S256G/G296R, S48V/G203V/S256G/G296R/K373V, S48V/ G203V/S256G/K373V, S48V/G203V/G296R/K373V, S48V/G203V/G296R/K373V/Q374L, S48V/G203V/ K373V, S48V/S256G/G296R/K373V, S48V/S256G/K373V, S48V/K373V, R67E/Y70G/R181K/G203V/S256G/G296R/ K373V, R67E/Y70G/R181K/S256G/G296R/K373V, R67E/ Y70G/R181K/K373V, R67E/R181K/G203V/S256G/ G296R, R67E/R181K/G203V/S256G/G296R/K373V, R67E/R181K/G203V/S256G/K373V, R67E/G203V/ S256G/G296R/K373V, R67E/S256/G296R/K373V, Y70G/ R181K/G203V/S256G/G296R/K373V, Y70G/R181K/ G203V/G296R/K373V, Y70G/G203V, Y70G/G203V/S256/ G296R/K373V, Y70G/G203V/S256G/K373V, Y70G/ G203V/G296R/K373V, E74T/F136Y/P215N/H234Y/ R282K/F297W/E346A, E74T/F136Y/P215N/H234Y/ R282K/E346A, E74T/F136Y/P215N/H234Y/F297W, E74T/F136Y/P215N/H234Y/F297W/N343Y/E346A, E74T/F136Y/P215N/H234Y/F297W/E346A, E74T/F136Y/ P215N/H234Y/E346A, E74T/F136Y/P215N/R282K/ F297W/E346A, E74T/F136Y/P215N/R282K/E346A, E74T/F136Y/P215N/F297W/E346A, E74T/F136Y/P215N/ E346A, E74T/F136Y/H234Y/R282K/F297W/E346A, E74T/F136Y/H234Y/E346A, E74T/F136Y/R282K/ F297W/E346A, E74T/P215N, E74T/P215N/H234Y/ R282K/F297W/E346A, E74T/P215N/R282K/F297W/ E346A, E74T/P215N/E346A, F136Y/P215N/H234Y/ R282K/F297W/E346A, F136Y/P215N/R282K/F297W, F136Y/P215N/R282K/F297W/E346A, F136Y/P215N/

R282K/E346A, F136Y/P215N/F297W/E346A, F136Y/ P215N/E346A, F136Y/H234Y/F297W, F136Y/H234Y/ F297W/E346A, F136Y/H234Y/E346A, F136Y/R282K/ F297W, R181K/G203V/S256G, R181K/G203V/S256G/ G296R, R181K/G203V/S256G/G296R/K373V, R181K/ G203V/S256G/K373V, R181K/G203V/G296R/K373V, R181K/G203V/K373V, R181K/S256G/G296R/K373V, R181K/G296R, G203L/P224T/R254Q/K373M, G203L/ R254Q, G203L/R254Q/N343R/E346H/K373M, G203L/ R254Q/N343R/K373M, G203L/R254Q/E346H, G203L/ R254Q/E346H/K373M, G203U/R254Q/K373M, G203L/ E346H/K373M, G203U/K373M, G203V/N209Y/S256G/ K373V, G203V/S256G, G203V/S256G/G296R, G203V/ S256/G296R/H320Y/K373V, G203V/S256G/G296R/ K373V, G203V/S256/G296R/K373V/H386Y, G203V/ S256G/K373V, G203V/G296R/K373V, G203V/K373V, P215N/H234Y/R282K/F297W/E346A, P215N/H234Y/ R282K/E346A, P215N/H234Y/E346A, H234Y/R282K/ E346A, R254Q, R254Q/E346H, R254Q/E346H/K373M, R254Q/K373M, S256G/G296R, S256G/G296R/K373V, S256G/K373V, R282K/F297W/E346A, N343R/K373M, and K373M/V, wherein the positions are numbered with reference to SEQ ID NO:2.

In some embodiments, the engineered transglutaminase polypeptides comprise substitutions at one or more positions selected from 48/49, 49, 50, 50, 331, 291, 292, 330, and 331, wherein the positions are numbered with reference to SEQ ID NO:34. In some embodiments, the engineered transglutaminase polypeptides comprise one or more substitutions selected from 48S/49W, 49Y, 50A/F/Q/R, 331H/P/V, 291C, 292R. 330H/Y, and 331R, wherein the positions are numbered with reference to SEQ ID NO:34. In some embodiments, the engineered transglutaminase polypeptides comprise one or more substitutions selected from K48S/D49W, D49Y, D50A/F/Q/R, L331H/P/V, T291C, S292R, S330H/Y, and L331R, wherein the positions are numbered with reference to SEQ ID NO:34.

In some embodiments, the engineered transglutaminase polypeptides comprise substitutions at one or more positions selected from 27/48/67/70/74/234/256/282/346/373, 27/48/ 67/70/136/203/215/256/282/346/373, 27/48/67/70/346/373, 27/48/67/74/203/256/346/373, 27/67/234/296/373, 45/287/ 328/333, 45/292/328, 48, 48/284/292/333, 48/287/292/297, 48/287/297/328/333, 48/292, 48/292/297, 48/49/50/292/ 331, 48/49/50/292, 48/49/50/331, 48/49/330/331, 48/49/50/ 349, 48/49/50/291/292/331, 48/49/50/292/331, 48/67/70/ 203/215/234/256/346, 48/67/70/234/256/282/297/346, 48/67/70/346, 48/67/74/203/234/256/282/346/373, 48/67/ 74/234/297/346/373, 48/67/74/346, 48/67/203/346/373, 48/67/234/256/297/346/373, 48/67/234/256/346/373, 48/67/215/282/297/346/373, 48/67/346/373, 48/70/74/297/ 346/373, 48/70/203/215/256/282/346/373, 48/70/215/234/ 256/346/373, 48/74/203/234/256/346/373, 48/74/234/256/ 297/346/373, 48/136/256/346/373, 48/203/234/256/297/ 346/373, 48/203/234/256/346/373, 48/203/234/346/373, 48/203/296/373, 48/215/234/346/373, 48/215/346/373, 48/234/256/296/346/373, 48/234/256/346/373, 48/256/373, 49/50/292/331, 49/50/292/331/349, 49/50/331, 49/50/331/ 349, 50, 67/70/74/136/203/215/256/346/373, 67/70/74/203/ 215/234/346/373, 67/70/74/215/234/297/346/373, 67/70/ 74/215/256/373, 67/70/136/203/297/346/373, 67/70/203/ 215/256/346/373, 67/70/203/373, 67/70/215, 67/74/136, 67/74/203/234/256, 67/74/215/256/297/346/373, 67/74/ 215/346/373, 67/74/256/346/373, 67/136/203/215/256/346/ 373, 67/136/203/256/346/373, 67/203/234/256/346/373, 67/203/297/346/373, 67/215/234/297/346/373, 67/297/346, 70/74/203/215/346/373, 136, 136/346/373, 203/234/346, 203/234/346/373, 203/373, 234/282, 287, 234/346/373, 287/ 292, 287/292/295/297, 287/292/297, 287/295/297, 287/330/ 333, 292, 292/297, 292/330/331, 292/330/331, 292/331, 292/331/349, 292/349, 295, 295/297/333, 297/328, 297/373, 328/333, 330, 330/331, 331, 331/349, 333, 346/373, and 373, wherein the positions are numbered with reference to SEQ ID NO:256. In some embodiments, the engineered transglutaminase polypeptides comprise one or more substitutions selected from 27S/48V/67E170G/74T/234Y/ 256G/282K/346A/373L, 27S/48V/67E/70G/136Y/203V/ 215H/256G/282K/346A/373V, 27S/48V/67E/70G/346A/ 373L, 27S/48V/67E/74T/203V/256G/346A/373M, 27S/ 67E/234Y/296R/373M, 45S/287S/328E/333P, 45S/292K/ 328E, 48A, 48A/284G/292K/333P, 48A/287S/292K/297Y, 48A/287S/297Y/328E/333P, 48A/292K, 48A/292K1297Y, 48S/49G/50A/292R/331P, 48S/49W/50A/292R, 48S/49W/ 50A/331V, 48S/491W/330Y/331V, 48S/49W/50A/349R, 48S/49Y/50A/291C/292R/331V, 48 S/49Y/50Q/292R/ 331V, 48V/67E/70G/203V/215H/234Y/256G/346A, 48V/ 67E/70G/234Y/256/282K/297W/346A, 48V/67E/70G/ 346A, 48V/67E174T/203V/234Y/256G/282K/346A/373M, 48V/67E/74T/234Y/297W/346A/373M, 48V/67E/74T/ 346A, 48V/67E/203V/346A/373M, 48V/67E/215H/282K/ 297W/346A/373M, 48V/67E/234Y/256G/297W/346A/ 373V, 48V/67E/234Y/256G/346A/373M, 48V/67E/346A/ 373M, 48V/70G/74T/297W/346A/373M, 48V/70G/203V/ 215H/256G/282K/346A/373V, 48V/70G/215H/234Y/ 256G/346A/373M, 48V/74T/203V/234Y/256G/346A/ 373V, 48V/74T/234Y/256/297W/346A/373V, 48V/136Y/ 256G/346A/373M, 48V/203V/234Y/256G/297W/346A/ 373V, 48V/203V/234Y/256G/346A/373M, 48V/203V/ 234Y/346A/373M, 48V/203V/296R/373M, 48V/215H/ 234Y/346A/373V, 48V/215H/346A/373M, 48V/234Y/ 256G/296R/346A/373M, 48V/234Y/256/346A/373M, 48V/ 256G/373L, 49/50A/292R/331V, 49G/50Q/292R/331V/ 349R, 49W/50A/331V, 49W/50A/331V/349R, 50A, 67E/ 70G/74T/136Y/203V/215H/256G/346A/373M, 67E/70G/ 74T/203V/215H/234Y/346A/373V, 67E/70G/74T/215H/ 234Y/297W/346A/373L, 67E/70G/74T/215H/256G/373M, 67E/70G/136Y/203V/297W/346A/373M, 67E/70G/203V/ 215H/256G/346A/373L, 67E/70G/203V/373M, 67E/70G/ 215H, 67E/74T/136Y, 67E/74T/203V/234Y/256G, 67E/ 74T/215H/256G/297W/346A/373L, 67E/74T/215H/346A/ 373V, 67E/74T/256G/346A/373M, 67E/136Y/203V/215H/ 256G/346A/373V, 67E136Y/203V/256G/346A/373M, 67E/ 203V/234Y/256G/346A/373V, 67E/203V/297W/346A/ 373M, 67E/215H/234Y/297W/346A/373V, 67E/297W/ 346A, 70G/74T/203V/215H/346A/373V, 136Y, 136Y/ 346A/373M, 203V/234Y/346A, 203V/234Y/346A/373V, 203V/373M, 234Y/282K, 234Y/346A/373M, 287S, 287S/ 292K, 287S/292K/295R/297Y, 287S/292K/297Y, 287S/ 295R/297Y, 287S/330G/333P, 292K, 292K1297Y, 292R, 292R/330Y/331P, 292R/330Y/331V, 292R/331V, 292R/ 331V/349R, 292134911, 295R, 295R/297Y/333P, 297Y/ 328E, 297W/373M, 328E/333P, 330Y, 330Y/331P, 331V, 331V/349R, 333P, 346A/373V, and 373M/V, wherein the positions are numbered with reference to SEQ ID NO:256, In some embodiments, the engineered transglutaminase polypeptides comprise one or more substitutions selected from N27S/K48V/R67E/Y70G/E74T/H234Y/S256G/ R282K/H346A/K373L, N27S/K48V/R67E/Y70G/F136Y/ L203V/P215H/S256G/R282K/H346A/K373V, N27S/ K48V/R67E/Y70G/H346A/K373L, N27S/K48V/R67E/ E74T/L203V/S256/H346A/K373M, N27S/R67E/H234Y/ G296R/K373M, A45S/P287S/N328E/A333P, A45S/S292K/ N328E, K48A, K48A/R284G/S292K/A333P, K48A/P287S/ S292K/F297Y, K48A/P287S/F297Y/N328E/A333P, K48A/ S292K, K48A/S292K/F297Y, K48S/D49G/R50A/S292R/ L331P, K48S/D49W/R50A/S292R, K48S/D49W/R50A/ L331V, K48S/D49W/S330Y/L331V, K48S/D49W/R50A/ S349R, K48S/D49Y/R50A/T291C/S292R/L331V, K48S/ D49Y/R50Q/S292R/L331V, K48V/R67E/Y70G/L203V/ P215H/H234Y/S256G/H346A, K48V/R67E/Y70G/H234Y/ S256G/R282K/F297W/H346A, K48V/R67E/Y70G/ H346A, K48V/R67E/E74T/L203V/H234Y/S256G/R282K/ H346A/K373M, K48V/R67E/E74T/H234Y/F297W/ H346A/K373M, K48V/R67E/E74T/H346A, K48V/R67E/ L203V/H346A/K373M, K48V/R67E/P215H/R282K/ F297W/H346A/K373M, K48V/R67E/H234Y/S256G/ F297W/H346A/K373V, K48V/R67E/H234Y/S256G/ H346A/K373M, K48V/R67E/H346A/K373M, K48V/ Y70G/E74T/F297W/H346A/K373M, K48V/Y70G/L203V/ P215H/S256G/R282K/H346A/K373V, K48V/Y70G/ P215H/H234Y/S256G/H346A/K373M, K48V/E74T/ L203V/H234Y/S256G/H346A/K373V, K48V/E74T/ H234Y/S256G/F297W/H346A/K373V, K48V/F136Y/ S256/H346A/K373M, K48V/L203V/H234Y/S256/F297W/ H346A/K373V, K48V/L203V/H234Y/S256G/H346A/ K373M, K48V/L203V/H234Y/H346A/K373M, K48V/ L203V/G296R/K373M, K48V/P215H/H234Y/H346A/ K373V, K48V/P215H/H346A/K373M, K48V/H234Y/ S256/G296R/H346A/K373M, K48V/H234Y/S256/H346A/ K373M, K48V/S256G/K373L, D49G/R50A/S292R/L331V, D49G/R50Q/S292R/L331V/S349R, D49W/R50A/L331V, D49W/R50A/L331V/S349R, R50A, R67E/Y70G/E74T/ F136Y/L203V/P215H/S256G/H346A/K373M, R67E/ Y70G/E74T/L203V/P215H/H234Y/H346A/K373V, R67E/ Y700/E74T/P215H/H234Y/F297W/H346A/K373L, R67E/ Y70G/E74T/P215H/S256G/K373M, R67E/Y70G/F136Y/ L203V/F297W/H346A/K373M, R67E/Y70G/L203V/ P215H/S256G/H346A/K373L, R67E/Y70G/L203V/ K373M, R67E/Y70G/P215H, R67E/E74T/F136Y, R67E/ E74T/L203V/H234Y/S256G, R67E/E74T/P215H/S2560/ F297W/H346A/K373L, R67E/E74T/P215H/H346A/ K373V, R67E/E74T/S256G/H346A/K373M, R67E/F136Y/ L203V/P215H/S256G/H346A/K373V, R67E/F136Y/ L203V/S256G/H346A/K373M, R67E/L203V/H234Y/ S256G/H346A/K373V, R67E/L203V/F297W/H346A/ K373M, R67E/P215H/H234Y/F297W/H346A/K373V, R67E/F297W/H346A, Y70G/E74T/L203V/P215H/H346A/ K373V, F136Y, F136Y/H346A/K373M, L203V/H234Y/ H346A, L203V/H234Y/H346A/K373V, L203V/K373M, H234Y/R282K, H234Y/H346A/K373M, P287S, P287S/ S292K, P287S/S292K/E295R/F297Y, P287S/S292K/ F297Y, P287S/E295R/F297Y, P287S/S330G/A333P, S292K, S292K/F297Y, S292R, S292R/S330Y/L331P, S292R/S330Y/L331V, S292R/L33IV, S292R/L331V/ S349R, S292R/S349R, E295R, E295R/F297Y/A333P, F297Y/N328E, F297W/K373M, N328E/A333P, S330Y, S330Y/L331P, L331V, L331V/S349R, A333P, H346A/ K373V, and K373M/V, wherein the positions are numbered with reference to SEQ ID NO:256.

The present invention also provides polynucleotides encoding the engineered transglutaminase polypeptides. In some embodiments, the polynucleotides are operatively linked to one or more heterologous regulatory sequences that control gene expression, to create a recombinant polynucleotide capable of expressing the polypeptide. Expression constructs containing a heterologous polynucleotide encoding the engineered transglutaminase polypeptides can be introduced into appropriate host cells to express the corresponding transglutaminase polypeptide.

Because of the knowledge of the codons corresponding to the various amino acids, availability of a protein sequence provides a description of all the polynucleotides capable of encoding the subject. The degeneracy of the genetic code, where the same amino acids are encoded by alternative or synonymous codons allows an extremely large number of nucleic acids to be made, all of which encode the improved transglutaminase enzymes disclosed herein. Thus, having identified a particular amino acid sequence, those skilled in the art could make any number of different nucleic acids by simply modifying the sequence of one or more codons in a way which does not change the amino acid sequence of the protein. In this regard, the present disclosure specifically contemplates each and every possible variation of polynucleotides that could be made by selecting combinations based on the possible codon choices, and all such variations are to be considered specifically disclosed for any polypeptide disclosed herein, including the amino acid sequences presented in the Tables in the Examples herein.

In various embodiments, the codons are preferably selected to fit the host cell in which the protein is being produced. For example, preferred codons used in bacteria are used to express the gene in bacteria: preferred codons used in yeast are used for expression in yeast; and preferred codons used in mammals are used for expression in mammalian cells.

In some embodiments, all codons need not be replaced to optimize the codon usage of the transglutaminase polypeptides since the natural sequence will comprise preferred codons and because use of preferred codons may not be required for all amino acid residues. Consequently, codon optimized polynucleotides encoding the transglutaminase enzymes may contain preferred codons at about 40%, 50%, 60%, 70%, 80%, or greater than 90% of codon positions of the full length coding region.

In some embodiments, the polynucleotide comprises a nucleotide sequence encoding a transglutaminase polypeptide with an amino acid sequence that has at least about 85%, 86%, 87%, 88%, 89%, 90%, 91%, 92%, 93%, 94%, 95%, 96%, 97%, 98%, or 99% or more sequence identity to SEQ ID NO: 2, 6, 34, and/or 256. In some embodiments, the polynucleotide comprises a nucleotide sequence encoding a transglutaminase polypeptide with an amino acid sequence that has at least 85%, 86%, 87%, 88%, 89%, 90%, 91%, 92%, 93%, 94%, 95%, 96%, 97%, 98%/0, or 99% or more sequence identity to SEQ ID NO: 2, 6, 34, and/or 256. In some embodiments, the polynucleotide encodes a transglutaminase amino acid sequence of SEQ ID NO: 2, 6, 34, and/or 256. In some embodiments, the present invention provides polynucleotide sequences having at least about 85%, 86%, 87%, 88%, 89%, 90%, 91%, 92%, 93%, 94%, 95%, 96%, 97%/0, 98%, or 99% or more sequence identity to SEQ ID NO: 1, 5, 33, and/or 255. In some embodiments, the present invention provides polynucleotide sequences having at least 85%, 86%, 87%, 88%, 89%, 90%, 91%, 92%, 93%, 94%, 95%, 96%, 97%, 98%, or 99% or more sequence identity to SEQ ID NO: 1, 5, 33, and/or 255.

In some embodiments, the isolated polynucleotide encoding an improved In some embodiments, the polynucleotide comprises a nucleotide sequence encoding a transglutaminase polypeptide with an amino acid sequence that has at least about 85%, 86%, 87%, 88%, 89%, 90%, 91%, 92%, 93%, 94%, 95%, 96%, 97%, 98%, or 99% or more sequence identity to SEQ ID NO: 2, 6, 34, and/or 256. The polypeptide is manipulated in a variety of ways to provide for improved activity and/or expression of the polypeptide. Manipulation of the isolated polynucleotide prior to its insertion into a vector may be desirable or necessary depending on the expression vector. The techniques for modifying polynucleotides and nucleic acid sequences utilizing recombinant DNA methods are well known in the art.

For example, mutagenesis and directed evolution methods can be readily applied to polynucleotides to generate variant libraries that can be expressed, screened, and assayed.

Mutagenesis and directed evolution methods are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, and all related US and non-US counterparts: Ling et al., Anal. Biochem., 254(2):157-78 [1997]; Dale et al., Meth. Mol. Biol., 57:369-74 [1996]1 Smith, Ann. Rev. Genet, 19:423-462 [1985]; Botstein et al., Science, 229:1193-1201 [1985] Carter, Biochem. J., 237:1-7 Kramer et al., Cell, 38:879-887 [1984]; Wells et al., Gene, 34:315-323 [1985] Minshull et al., Curr. Op. Chem. Biol., 3:284-290 [1999]; Christians et al., Nat. Biotechnol., 17:259-264 [1999]; Crameri et al., Nature, 391:288-291 [1998]1 Crameri, et al., Nat. Biotechnol., 15:436-438 [1997]; Zhang et al., Proc. Nat. Acad. Sci. U.S.A., 94:4504-4509 [1997] Crameri et al., Nat. Biotechnol., 14:315-319 [1996]; Stemmer, Nature, 370:389-391 [1994] Stemmer, Proc. Nat. Acad. Sci. USA, 91:10747-10751 [1994]; WO 95/22625; WO 97/0078; WO 97/35966; WO 98/27230: WO 00/42651; WO 01/75767; and WO 2009/152336, all of which are incorporated herein by reference).

In some embodiments, the variant transglutaminase of the present invention further comprise additional sequences that do not alter the encoded activity of the enzyme. For example, in some embodiments, the variant transglutaminase are linked to an epitope tag or to another sequence useful in purification.

In some embodiments, the variant transglutaminase polypeptides of the present invention are secreted from the host cell in which they are expressed (e.g., a yeast or filamentous fungal host cell) and are expressed as a pre-protein including a signal peptide (i.e., an amino acid sequence linked to the amino terminus of a polypeptide and which directs the encoded polypeptide into the cell secretory pathway).

In some embodiments, the signal peptide is an endogenous *S. mobaraensis* transglutaminase signal peptide. In some additional embodiments, signal peptides from other *S. mobaraensis* secreted proteins are used. In some embodiments, other signal peptides find use, depending on the host cell and other factors. Effective signal peptide coding regions for filamentous fungal host cells include, but are not limited to, the signal peptide coding regions obtained from *Aspergillus oryzae* TAKA amylase, *Aspergillus niger* neutral amylase, *Aspergillus niger* glucoamylase, *Rhizomucor miehei* aspartic proteinase, *Humicola insolens* cellulase, *Humicola lanuginosa* lipase, and *T. reesei* cellobiohydrolase II. Signal peptide coding regions for bacterial host cells include, but are not limited to the signal peptide coding regions obtained from the genes for *Bacillus* NCIB 11837 maltogenic amylase, *Bacillus stearothermophilus* alpha-amylase, *Bacillus licheniformis* subtilisin, *Bacillus licheniformis* β-lactamase, *Bacillus stearothermophilus* neutral proteases (nprT, nprS, nprM), and *Bacillus subtilis* prsA. In some additional embodiments, other signal peptides find use in the present invention (See e.g., Simonen and Palva, Microbiol. Rev., 57: 109-137 [1993], incorporated herein by reference). Additional useful signal peptides for yeast host cells include those from the genes for *Saccharomyces cerevisiae* alpha-factor, *Saccharomyces cerevisiae* SUC2 invertase (See e.g. Taussig and Carlson, Nucl. Acids Res., 11:1943-54 [1983]; SwissProt Accession No. P00724; and Romanos et al., Yeast 8:423-488 [1992]). In some embodiments, variants of these signal peptides and other signal peptides find use. Indeed, it is not intended that the present invention be limited to any specific signal peptide, as any suitable signal peptide known in the art finds use in the present invention.

In some embodiments, the present invention provides polynucleotides encoding variant transglutaminase polypeptides, and/or biologically active fragments thereof, as described herein. In some embodiments, the polynucleotide is operably linked to one or more heterologous regulatory or control sequences that control gene expression to create a recombinant polynucleotide capable of expressing the polypeptide. In some embodiments, expression constructs containing a heterologous polynucleotide encoding a variant transglutaminase is introduced into appropriate host cells to express the variant transglutaminase.

Those of ordinary skill in the art understand that due to the degeneracy of the genetic code, a multitude of nucleotide sequences encoding variant transglutaminase polypeptides of the present invention exist. For example, the codons AGA, AGG, CGA, CGC, CGG, and CGU all encode the amino acid arginine. Thus, at every position in the nucleic acids of the invention where an arginine is specified by a codon, the codon can be altered to any of the corresponding codons described above without altering the encoded polypeptide. It is understood that "U" in an RNA sequence corresponds to "T" in a DNA sequence. The invention contemplates and provides each and every possible variation of nucleic acid sequence encoding a polypeptide of the invention that could be made by selecting combinations based on possible codon choices.

As indicated above, DNA sequence encoding a transglutaminase may also be designed for high codon usage bias codons (codons that are used at higher frequency in the protein coding regions than other codons that code for the same amino acid). The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. A codon whose frequency increases with the level of gene expression is typically an optimal codon for expression. In particular, a DNA sequence can be optimized for expression in a particular host organism. A variety of methods are well-known in the art for determining the codon frequency (e.g., codon usage, relative synonymous codon usage) and codon preference in specific organisms, including multivariate analysis (e.g., using cluster analysis or correspondence analysis,) and the effective number of codons used in a gene. The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTs), or predicted coding regions of genomic sequences, as is well-known in the art. Polynucleotides encoding variant transglutaminases can be prepared using any suitable methods known in the art. Typically, oligonucleotides are individually synthesized, then joined (e.g., by enzymatic or chemical ligation methods, or polymerase-mediated methods) to form essentially any desired continuous sequence. In some embodiments, polynucleotides of the present invention are prepared by chemical synthesis using, any suitable methods known in the art, including but not limited to automated synthetic methods. For example, in the phosphoramidite method, oligonucleotides are synthesized (e.g., in an automatic DNA synthesizer), purified, annealed, ligated and cloned in appropriate vectors. In some embodiments, double stranded DNA fragments are then obtained either by synthesizing the complementary strand and annealing the strands together under appropriate conditions, or by adding the complementary strand using DNA polymerase with an appropriate primer sequence. There are numerous general and standard texts that provide methods useful in the present invention are well known to those skilled in the art.

The engineered transglutaminases can be obtained by subjecting the polynucleotide encoding the naturally occurring transglutaminase to mutagenesis and/or directed evolution methods, as discussed above. Mutagenesis may be performed in accordance with any of the techniques known in the art, including random and site-specific mutagenesis. Directed evolution can be performed with any of the techniques known in the art to screen for improved variants including shuffling. Other directed evolution procedures that find use include, but are not limited to staggered extension process (StEP), in vitro recombination, mutagenic PCR, cassette mutagenesis, splicing by overlap extension (SOEing), ProSAR™ directed evolution methods, etc., as well as any other suitable methods.

The clones obtained following mutagenesis treatment are screened for engineered transglutaminases having a desired improved enzyme property. Measuring enzyme activity from the expression libraries can be performed using the standard biochemistry technique of monitoring the rate of product formation. Where an improved enzyme property desired is thermal stability, enzyme activity may be measured after subjecting the enzyme preparations to a defined temperature and measuring the amount of enzyme activity remaining after heat treatments. Clones containing a polynucleotide encoding a transglutaminase are then isolated, sequenced to identify the nucleotide sequence changes (if any), and used to express the enzyme in a host cell.

When the sequence of the engineered polypeptide is known, the polynucleotides encoding the enzyme can be prepared by standard solid-phase methods, according to known synthetic methods. In some embodiments, fragments of up to about 100 bases can be individually synthesized, then joined (e.g., by enzymatic or chemical ligation methods, or polymerase mediated methods) to form any desired continuous sequence. For example, polynucleotides and oligonucleotides of the invention can be prepared by chemical synthesis (e.g., using the classical phosphoramidite method described by Beaucage et al., Tet. Lett., 22:1859-69 [1981], or the method described by Matthes et al., EMBO J., 3:801-05 [1984], as it is typically practiced in automated synthetic methods). According to the phosphoramidite method, oligonucleotides are synthesized (e.g., in an automatic DNA synthesizer), purified, annealed, ligated and cloned in appropriate vectors. In addition, essentially any nucleic acid can be obtained from any of a variety of commercial sources (e.g., The Midland Certified Reagent Company, Midland, Tex., The Great American Gene Company, Ramona, Calif., ExpressGen Inc. Chicago, Ill., Operon Technologies Inc., Alameda, Calif., and many others).

The present invention also provides recombinant constructs comprising a sequence encoding at least one variant transglutaminase, as provided herein. In some embodiments, the present invention provides an expression vector comprising a variant transglutaminase polynucleotide operably linked to a heterologous promoter. In some embodiments, expression vectors of the present invention are used to transform appropriate host cells to permit the host cells to express the variant transglutaminase protein. Methods for recombinant expression of proteins in fungi and other organisms are well known in the art, and a number of expression vectors are available or can be constructed using routine methods. In some embodiments, nucleic acid constructs of the present invention comprise a vector, such as, a plasmid, a cosmid, a phage, a virus, a bacterial artificial chromosome (BAC), a yeast artificial chromosome (YAC), and the like, into which a nucleic acid sequence of the invention has been inserted. In some embodiments, polynucleotides of the present invention are incorporated into any one of a variety of expression vectors suitable for expressing variant transglutaminase polypeptide(s). Suitable vectors include, but are not limited to chromosomal, nonchromosomal and synthetic DNA sequences (e.g., derivatives of SV40), as well as bacterial plasmids, phage DNA, baculovirus, yeast plasmids, vectors derived from combinations of plasmids and phage DNA, viral DNA such as vaccinia, adenovirus, fowl pox virus, pseudorabies, adenovirus, adeno-associated virus, retroviruses, and many others. Any suitable vector that transduces genetic material into a cell, and, if replication is desired, which is replicable and viable in the relevant host finds use in the present invention.

In some embodiments, the construct further comprises regulatory sequences, including but not limited to a promoter, operably linked to the protein encoding sequence. Large numbers of suitable vectors and promoters are known to those of skill in the art. Indeed, in some embodiments, in order to obtain high levels of expression in a particular host it is often useful to express the variant transglutaminases of the present invention under the control of a heterologous promoter. In some embodiments, a promoter sequence is operably linked to the 5' region of the variant transglutaminase coding sequence using any suitable method known in the art. Examples of useful promoters for expression of variant transglutaminases include, but are not limited to promoters from fungi. In some embodiments, a promoter sequence that drives expression of a gene other than a transglutaminase gene in a fungal strain finds use. As a non-limiting example, a fungal promoter from a gene encoding an endoglucanase may be used. In some embodiments, a promoter sequence that drives the expression of a transglutaminase gene in a fungal strain other than the fungal strain from which the transglutaminases were derived finds use. Examples of other suitable promoters useful for directing the transcription of the nucleotide constructs of the present invention in a filamentous fungal host cell include, but are not limited to promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787, incorporated herein by reference), as well as the NA2-tpi promoter (a hybrid of the promoters from the genes for *Aspergillus niger* neutral alpha-amylase and *Aspergillus oryzae* triose phosphate isomerase), promoters such as cbh1, cbh2, egl1, egl2, pepA, hfb1, hfb2, xyn1, amy, and glaA (See e.g., Nunberg et al., Mol. Cell Biol., 4:2306-2315 [1984]; Boel et al., EMBO J., 3:1581-85 [1984]; and European Patent Appln. 137280, all of which are incorporated herein by reference), and mutant, truncated, and hybrid promoters thereof.

In yeast host cells, useful promoters include, but are not limited to those from the genes for *Saccharomyces cerevisiae* enolase (eno-1), *Saccharomyces cerevisiae* galactokinase (gall), *Saccharomyces cerevisiae* alcohol dehydrogenase/glyceraldehyde-3-phosphate dehydrogenase (ADH2/GAP), and *S. cerevisiae* 3-phosphoglycerate kinase. Additional useful promoters useful for yeast host cells are known in the art (See e.g., Romanos et al., Yeast 8:423-488 [1992], incorporated herein by reference). In addition, promoters associated with chitinase production in fungi find use in the present invention (See e.g., Blaiseau and Lafay, Gene 120243-248 [1992]; and Limon et al., Curr. Genet., 28:478-83 [1995], both of which are incorporated herein by reference).

For bacterial host cells, suitable promoters for directing transcription of the nucleic acid constructs of the present disclosure, include but are not limited to the promoters obtained from the *E. coli* lac operon, *E. coli* trp operon, bacteriophage lambda, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (See e.g., Villa-Kamaroff et al., Proc. Natl. Acad. Sci. USA 75: 3727-3731 [1978]), as well as the tac promoter (See e.g., DeBoer et al., Proc. Natl. Acad. Sci. USA 80: 21-25 [1983]).

In some embodiments, cloned variant transglutaminases of the present invention also have a suitable transcription terminator sequence, a sequence recognized by a host cell to terminate transcription. The terminator sequence is operably linked to the 3' terminus of the nucleic acid sequence encoding the polypeptide. Any terminator that is functional in the host cell of choice finds use in the present invention. Exemplary transcription terminators for filamentous fungal host cells include, but are not limited to those obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease (See e.g., U.S. Pat. No. 7,399,627, incorporated herein by reference). In some embodiments, exemplary terminators for yeast host cells include those obtained from the genes for *Saccharomyces cerevisiae* enolase, *Saccharomyces cerevisiae* cytochrome C (CYC), and *Saccharomyces cerevisiae* glyceraldehyde-3-phosphate dehydrogenase. Other useful terminators for yeast host cells are well-known to those skilled in the art (See e.g., Romanos et al., Yeast 8:423-88 L19921).

In some embodiments, a suitable leader sequence is part of a cloned variant transglutaminase sequence, which is a nontranslated region of an mRNA that is important for translation by the host cell. The leader sequence is operably linked to the 5' terminus of the nucleic acid sequence encoding the polypeptide. Any leader sequence that is functional in the host cell of choice finds use in the present invention. Exemplary leaders for filamentous fungal host cells include, but are not limited to those obtained from the genes for *Aspergillus oryzae* TAKA amylase and *Aspergillus nidulans* triose phosphate isomerase. Suitable leaders for yeast host cells include, but are not limited to those obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

In some embodiments, the sequences of the present invention also comprise a polyadenylation sequence, which is a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice finds use in the present invention. Exemplary polyadenylation sequences for filamentous fungal host cells include, but are not limited to those obtained from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are known in the art (See e.g., Guo and Sherman, Mol. Cell. Biol., 15:5983-5990 [1995]).

In some embodiments, the control sequence comprises a signal peptide coding region encoding an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. The foreign signal peptide coding region may be required where the coding sequence does not naturally contain a signal peptide coding region. Alternatively, the foreign signal peptide coding region may simply replace the natural signal peptide coding region in order to enhance secretion of the polypeptide. However, any signal peptide coding region which directs the expressed polypeptide into the secretory pathway of a host cell of choice may be used in the present invention.

Effective signal peptide coding regions for bacterial host cells include, but are not limited to the signal peptide coding regions obtained from the genes for *Bacillus* NCIB 11837 maltogenic amylase, *Bacillus stearothermophilus* alpha-amylase, *Bacillus licheniformis* subtilisin. *Bacillus licheniformis* beta-lactamase, *Bacillus stearothermophilus* neutral proteases (nprT, nprS, nprM), and *Bacillus subtilis* prsA. Further signal peptides are known in the art (See e.g., Simonen and Palva. Microbiol. Rev., 57: 109-137 [1993]).

Effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase.

Useful signal peptides for yeast host cells include, but are not limited to genes for *Saccharomyces cerevisiae* alpha-factor and *Saccharomyces cerevisiae* invertase. Other useful signal peptide coding regions are known in the art (See e.g., Romanos et al., [1992], supra).

In some embodiments, the control sequence comprises a propeptide coding region that codes for an amino acid sequence positioned at the amino terminus of a polypeptide. The resultant polypeptide is known as a proenzyme or propolypeptide (or a zymogen in some cases). A propolypeptide is generally inactive and can be converted to a mature active transglutaminase polypeptide by catalytic or autocatalytic cleavage of the propeptide from the propolypeptide. The propeptide coding region may be obtained from the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836).

Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also used to allow the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, as examples, the ADH2 system or GAL1 system. In filamentous fungi, suitable regulatory sequences include the TAKA alpha-amylase promoter, *Aspergillus niger* glucoamylase promoter, and *Aspergillus oryzae* glucoamylase promoter.

Other examples of regulatory sequences are those which allow for gene amplification. In eukaryotic systems, these include the dihydrofolate reductase gene, which is amplified in the presence of methotrexate, and the metallothionein genes, which are amplified with heavy metals. In these cases, the nucleic acid sequence encoding the transglutaminase polypeptide of the present invention would be operably linked with the regulatory sequence.

Thus, in additional embodiments, the present invention provides recombinant expression vectors comprising a polynucleotide encoding an engineered transglutaminase polypeptide or a variant thereof, and one or more expression regulating regions such as a promoter and a terminator, a replication origin, etc., depending on the type of hosts into which they are to be introduced. In some embodiments, the various nucleic acid and control sequences described above are joined together to produce a recombinant expression vector that may include one or more convenient restriction sites to allow for insertion or substitution of the nucleic acid sequence encoding the polypeptide at such sites. Alternatively, in some embodiments, the nucleic acid sequences are expressed by inserting the nucleic acid sequence or a nucleic acid construct comprising the sequence into an appropriate vector for expression. In creating the expression vector, the coding sequence is located in the vector so that the coding sequence is operably linked with the appropriate control sequences for expression.

The recombinant expression vector comprises any suitable vector (e.g., a plasmid or virus), that can be conveniently subjected to recombinant DNA procedures and can bring about the expression of the polynucleotide sequence. The choice of the vector typically depends on the compatibility of the vector with the host cell into which the vector is to be introduced. In some embodiments, the vectors are linear or closed circular plasmids.

In some embodiments, the expression vector is an autonomously replicating vector (i.e., a vector that exists as an extrachromosomal entity, the replication of which is independent of chromosomal replication, such as a plasmid, an extrachromosomal element, a minichromosome, or an artificial chromosome). In some embodiments, the vector contains any means for assuring self-replication. Alternatively, in some other embodiments, upon being introduced into the host cell, the vector is integrated into the genome and replicated together with the chromosome(s) into which it has been integrated. Furthermore, in additional embodiments, a single vector or plasmid or two or more vectors or plasmids which together contain the total DNA to be introduced into the genome of the host cell, or a transposon find use.

In some embodiments, the expression vector of the present invention contains one or more selectable markers, which permit easy selection of transformed cells. A "selectable marker" is a gene, the product of which provides for biocide or viral resistance, resistance to antimicrobials or heavy metals, prototrophy to auxotrophs, and the like. Any suitable selectable markers for use in a filamentous fungal host cell find use in the present invention, including, but are not limited to, amdS (acetamidase), argB (omithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Additional markers useful in host cells such as *Aspergillus*, include but are not limited to the amdS and pyrG genes of *Aspergillus nidulans* or *Aspergillus oryzae*, and the bar gene of *Streptomyces hygroscopicus*. Suitable markers for yeast host cells include, but are not limited to ADE2, HIS3, LEU2, LYS2, MET3, TRP1, and URA3. Examples of bacterial selectable markers include, but are not limited to the dal genes from *Bacillus subtilis* or *Bacillus licheniformis*, or markers, which confer antibiotic resistance such as ampicillin, kanamycin, chloramphenicol, and or tetracycline resistance.

In some embodiments, the expression vectors of the present invention contain an element(s) that permits integration of the vector into the host cell's genome or autonomous replication of the vector in the cell independent of the genome. In some embodiments involving integration into the host cell genome, the vectors rely on the nucleic acid sequence encoding the polypeptide or any other element of the vector for integration of the vector into the genome by homologous or nonhomologous recombination.

In some alternative embodiments, the expression vectors contain additional nucleic acid sequences for directing integration by homologous recombination into the genome of the host cell. The additional nucleic acid sequences enable the vector to be integrated into the host cell genome at a precise location(s) in the chromosome(s). To increase the likelihood of integration at a precise location, the integrational elements preferably contain a sufficient number of nucleotides, such as 100 to 10,000 base pairs, preferably 400 to 10,000 base pairs, and most preferably 800 to 10,000 base pairs, which are highly homologous with the corresponding target sequence to enhance the probability of homologous recombination. The integrational elements may be any sequence that is homologous with the target sequence in the genome of the host cell. Furthermore, the integrational elements may be non-encoding or encoding nucleic acid sequences. On the other hand, the vector may be integrated into the genome of the host cell by non-homologous recombination.

For autonomous replication, the vector may further comprise an origin of replication enabling the vector to replicate autonomously in the host cell in question. Examples of bacterial origins of replication are P15A ori or the origins of replication of plasmids pBR322, pUC 19, pACYC177 (which plasmid has the P15A ori), or pACYC184 permitting replication in *E. coli*, and pUB 110, pE 194, pTA1060, or pAM□1 permitting replication in *Bacillus*. Examples of origins of replication for use in a yeast host cell are the 2 micron origin of replication, ARS1, ARS4, the combination of ARS1 and CEN3, and the combination of ARS4 and CEN6. The origin of replication may be one having a mutation which makes it's functioning temperature-sensitive in the host cell (See e.g., Ehrlich, Proc. Natl. Acad. Sci. USA 75:1433 [1978]).

In some embodiments, more than one copy of a nucleic acid sequence of the present invention is inserted into the host cell to increase production of the gene product. An increase in the copy number of the nucleic acid sequence can be obtained by integrating at least one additional copy of the sequence into the host cell genome or by including an amplifiable selectable marker gene with the nucleic acid sequence where cells containing amplified copies of the selectable marker gene, and thereby additional copies of the nucleic acid sequence, can be selected for by cultivating the cells in the presence of the appropriate selectable agent.

Many of the expression vectors for use in the present invention are commercially available. Suitable commercial expression vectors include, but are not limited to the p3xFLAG™ expression vectors (Sigma-Aldrich Chemicals), which include a CMV promoter and hGH polyadenylation site for expression in mammalian host cells and a pBR322 origin of replication and ampicillin resistance markers for amplification in *E. coli*. Other suitable expression vectors include, but are not limited to pBluescriptII SK(−) and pBK-CMV (Stratagene), and plasmids derived from pBR322 (Gibco BRL), pUC (Gibco BRL), pREP4, pCEP4 (Invitrogen) or pPoly (See e.g., Lathe et al., Gene 57:193-201 [1987]).

Thus, in some embodiments, a vector comprising a sequence encoding at least one variant transglutaminase is transformed into a host cell in order to allow propagation of the vector and expression of the variant transglutaminase(s). In some embodiments, the variant transglutaminases are post-translationally modified to remove the signal peptide and in some cases may be cleaved after secretion. In some embodiments, the transformed host cell described above is cultured in a suitable nutrient medium under conditions permitting the expression of the variant transglutaminase(s). Any suitable medium useful for culturing the host cells finds use in the present invention, including, but not limited to minimal or complex media containing appropriate supplements. In some embodiments, host cells are grown in HTP media. Suitable media are available from various commercial suppliers or may be prepared according to published recipes (e.g., in catalogues of the American Type Culture Collection).

In another aspect, the present invention provides host cells comprising a polynucleotide encoding an improved transglutaminase polypeptide provided herein, the polynucleotide being operatively linked to one or more control sequences for expression of the transglutaminase enzyme in the host cell. Host cells for use in expressing the transglutaminase polypeptides encoded by the expression vectors of the present invention are well known in the art and include but are not limited to, bacterial cells, such as *E. coli, Bacillus megaterium, Lactobacillus kefir, Streptomyces* and *Salmonella typhimurium* cells; fungal cells, such as yeast cells (e.g., *Saccharomyces cerevisiae* or *Pichia pastoris* (ATCC Accession No. 201178)): insect cells such as *Drosophila* S2 and *Spodoptera* Sf9 cells; animal cells such as CHO, COS, BHK, 293, and Bowes melanoma cells; and plant cells. Appropriate culture media and growth conditions for the above-described host cells are well known in the art.

Polynucleotides for expression of the transglutaminase may be introduced into cells by various methods known in the art. Techniques include among others, electroporation, biolistic particle bombardment, liposome mediated transfection, calcium chloride transfection, and protoplast fusion. Various methods for introducing polynucleotides into cells are known to those skilled in the art.

In some embodiments, the host cell is a eukaryotic cell. Suitable eukaryotic host cells include, but are not limited to, fungal cells, algal cells, insect cells, and plant cells. Suitable fungal host cells include, but are not limited to, Ascomycota, Basidiomycota, Deuteromycota, Zygomycota, Fungi imperfecti. In some embodiments, the fungal host cells are yeast cells and filamentous fungal cells.

The filamentous fungal host cells of the present invention include all filamentous forms of the subdivision Eumycotina and Oomycota. Filamentous fungi are characterized by a vegetative mycelium with a cell wall composed of chitin, cellulose and other complex polysaccharides. The filamentous fungal host cells of the present invention are morphologically distinct from yeast.

In some embodiments of the present invention, the filamentous fungal host cells are of any suitable genus and species, including, but not limited to *Achlya, Acremonmum, Aspergillus, Aureobasidium, Bjerkandera, Ceriporiopsis, Cephalosporium, Chrysosporium, Cochliobolus, Corynascus, Crvphonectria, Cryptococcus, Coprinus, Coriolus, Diplodia, Endothis, Fusarium, Gibberella, Gliocladium, Humicola, Hypocrea, Myceliophihora, Mucor, Neurospora, Penicillium, Podospora, Phlebia, Piromyces, Pyriculana, Rhizomucor, Rhizopus, Schizophyllum, Scytahdium, Sporotrichum, Talaromyces, Thermoascus, Thielavia, Trametes, Tolvpocladium, Trichoderma, Verticillium*, and/or *Volvariella*, and/or teleomorphs, or anamorphs, and synonyms, basionyms, or taxonomic equivalents thereof.

In some embodiments of the present invention, the host cell is a yeast cell, including but not limited to cells of *Candida, Hansenula, Saccharomyces, Schizosaccharomyces, Pichia, Kluyveromyces*, or *Yarrowia* species. In some embodiments of the present invention, the yeast cell is *Hansenula polymorpha. Saccharomyces cerevisiae, Saccharomyces carlsbergensis, Saccharomyces diastaticus, Saccharomyces norbensis, Saccharomyces kluyver, Schizosaccharomvces pombe, Pichia pastoris, Pichia finlandica, Pichia trehalophila, Pichia kodamae, Pichia membranaefaciens, Pichia opuntiae, Pichia thermotolerans, Pichia salictaria, Pichia quercuum, Pichia pijperi, Pichia stipitis, Pichia methanolica, Pichia angusta, Kluyveromyces klctis, Candida albicans*, or *Yarrowia lipolytica*.

In some embodiments of the invention, the host cell is an algal cell such as *Chlamydomonas* (e.g., *C. reinhardtii*) and *Phormidium* (P. sp. ATCC29409).

In some other embodiments, the host cell is a prokaryotic cell. Suitable prokaryotic cells include, but are not limited to Gram-positive, Gram-negative and Gram-variable bacterial cells. Any suitable bacterial organism finds use in the present invention, including but not limited to *Agrobacterium, Alicyclobacillus, Anabaena, Anacystis. Acinetobacter, Acidothermus, Arthrobacter, Azobacter, Bacillus, Bifidobacterium, Brevibacterium, Butyrivibrio, Buchnera, Campestris, Camplyobacter, Clostridium, Corynebacterium, Chromatium, Coprcoccus, Escherichia, Enterococcus, Enterobacter, Erwinia, Fusobactertum, Faecalibacterium, Francisella, Flavobacterium, Geobacillus, Haemophilus, Helicobacter, Klebsiella, Lactobacillus, Lactococcus, Ilyobacter, Micrococcus, Microbacterium, Mesorhizobium, Methylobacterium, Methylobacterium, Mycobacterium, Neisseria, Pantoea, Pseudomonas, Prochlorococcus, Rhodobacter, Rhodopseudomonas, Rhodopseudomonas, Roseburta, Rhodospirillum, Rhodococcus, Scenedesmus, Streptomyces, Streptococcus, Synecoccus, Saccharomonospora, Staphylococcus, Serratia, Salmonella, Shigella, Thermoanaerobacterium, Tropheryma, Tularensis, Temecula, Thermosynechococcus, Thermococcus, Ureaplasma, Xanthomonas, Xylella, Yersinia* and *Zymomonas*. In some embodiments, the host cell is a species of *Agrobacterium, Acinetobacter, Azobacter, Bacillus, Bifidobacterium, Buchnera, Geobacillus, Campylobacter, Clostridium, Corynebacterium, Escherichia, Enterococcus, Erwinia, Flavobacterium, Lactobacillus, Lactococcus, Pantoea, Pseudomonas, Staphylococcus, Salmonella, Streptococcus, Streptomyces*, or *Zymomonas*. In some embodiments, the bacterial host strain is non-pathogenic to humans. In some embodiments the bacterial host strain is an industrial strain. Numerous bacterial industrial strains are known and suitable in the present invention. In some embodiments of the present invention, the bacterial host cell is an *Agrobacterium* species (e.g., *A. radiobacter, A. rhizogenes*, and *A. rubi*). In some embodiments of the present invention, the bacterial host cell is an *Arthrobacter* species (e.g., *A. aurescens, A. citreus, A. globiformis, A. hydrocarboglutamicus, A. mysorens, A. nicotianae, A. parafineus, A. protophonniae, A. roseoparqffinus, A. sulfireus*, and *A. ureafaciens*). In some embodiments of the present invention, the bacterial host cell is a *Bacillus* species (e.g., *B. thuringensis, B. anthracis, B. megaterium, B. subtilis, B. lentus, B. circulans, B. pumilus, B. lautus, B. coagulans, B. brevis, B. firmus, B. alkaophius, B. licheniformis, B. clausii, B. stearothermophilus, B. halodurans*, and *B. amyloliquefaciens*). In some embodiments, the host cell is an industrial *Bacillus* strain including but not limited to *B. subtilis, B. pumilus, B. licheniformis, B. megaterium. B. clausii, B. stearothermophilus*, or *B. amyloliquefaciens*. In some embodiments, the *Bacillus* host cells are *B. subtilis, B. licheniformis, B. megaterium, B. stearothermophilus*, and/or *B. amyloliquefaciens*. In some embodiments, the bacterial host cell is a *Clostridium* species (e.g., *C. acetobutylicum, C. tetani* E88, *C. lituseburense, C. saccharobutylicum, C. perfringens*, and *C. beijerinckii*). In some embodiments, the bacterial host cell is a *Corynebacterium* species (e.g., *C. glutamicum* and *C. acetoacidophilum*). In some embodiments the bacterial host cell is an *Escherichia* species (e.g., *E. coli*). In some embodiments, the host cell is *Escherichia coli* W3110. In some embodiments, the bacterial host cell is an *Erwinia* species (e.g., *E. uredovora, E. carotovora, E. ananas, E. herbicola, E. punctata*, and *E. terreus*). In some embodiments, the bacterial host cell is a *Pantoea* species (e.g., *P. citrea*, and *P. agglomerans*). In some embodiments the bacterial host cell is a *Pseudomonas* species (e.g., *P. putida, P. aeruginosa, P. mevalonii*, and *P.* sp. D-01 10). In some embodiments, the bacterial host cell is a *Streptococcus* species (e.g., *S. equisimiles, S. pyogenes*, and *S. uberis*). In some embodiments, the bacterial host cell is a *Streptomyces* species (e.g., *S. ambofaciens, S. achromogenes, S. avermrtilis, S. coelicolor, S. aureofaciens. S. aureus, S. fimgicidicus, S. griseus*, and *S. lividans*). In some embodiments, the bacterial host cell is a *Zymomonas* species (e.g., *Z. mobilis*, and *Z lipolytica*).

Many prokaryotic and eukaryotic strains that find use in the present invention are readily available to the public from a number of culture collections such as American Type Culture Collection (ATCC), Deutsche Sammlung von Mikroorganismen und Zellkulturen GmbH (DSM), Centraalbureau Voor Schimmelcultures (CBS), and Agricultural Research Service Patent Culture Collection, Northern Regional Research Center (NRRL).

In some embodiments, host cells are genetically modified to have characteristics that improve protein secretion, protein stability and/or other properties desirable for expression and/or secretion of a protein. Genetic modification can be achieved by genetic engineering techniques and/or classical microbiological techniques (e.g., chemical or UV mutagenesis and subsequent selection). Indeed, in some embodiments, combinations of recombinant modification and classical selection techniques are used to produce the host cells. Using recombinant technology, nucleic acid molecules can be introduced, deleted, inhibited or modified, in a manner that results in increased yields of transglutaminase variant(s) within the host cell and/or in the culture medium. For example, knockout of Alp1 function results in a cell that is protease deficient, and knockout of pyr5 function results in a cell with a pyrimidine deficient phenotype. In one genetic engineering approach, homologous recombination is used to induce targeted gene modifications by specifically targeting a gene in vivo to suppress expression of the encoded protein. In alternative approaches, siRNA, antisense and/or ribozyme technology find use in inhibiting gene expression. A variety of methods are known in the art for reducing expression of protein in cells, including, but not limited to deletion of all or part of the gene encoding the protein and site-specific mutagenesis to disrupt expression or activity of the gene product. (See e.g., Chaveroche et al., Nucl. Acids Res., 28:22 e97 [2000]; Cho et al., Molec. Plant Microbe Interact., 19:7-15 [2006]; Maruyama and Kitamoto, Biotechnol Lett. 30:1811-1817 [2008]; Takahashi et al., Mol. Gen. Genom., 272: 344-352 [2004]; and You et al., Arch. Micriobiol., 191:615-622 [2009], all of which are incorporated by reference herein). Random mutagenesis, followed by screening for desired mutations also finds use (See e.g., Combier et al., FEMS Microbiol. Lett., 220:141-8 [2003]; and Firon et al., Eukary. Cell 2:247-55 [2003], both of which are incorporated by reference).

Introduction of a vector or DNA construct into a host cell can be accomplished using any suitable method known in the art, including but not limited to calcium phosphate transfection, DEAE-dextran mediated transfection, PEG-mediated transformation, electroporation, or other common techniques known in the art. In some embodiments, the *Escherichia coli* expression vector pCK 100900i (See, US Pat. Appln. Publn. 2006/0195947, which is hereby incorporated by reference herein) finds use.

In some embodiments, the engineered host cells (i.e., "recombinant host cells") of the present invention are cultured in conventional nutrient media modified as appropriate for activating promoters, selecting transformants, or amplifying the transglutaminase polynucleotide. Culture conditions, such as temperature, pH and the like, are those previously used with the host cell selected for expression, and are well-known to those skilled in the art. As noted, many standard references and texts are available for the culture and production of many cells, including cells of bacterial, plant, animal (especially mammalian) and archebacterial origin.

In some embodiments, cells expressing the variant transglutaminase polypeptides of the invention are grown under batch or continuous fermentations conditions. Classical "batch fermentation" is a closed system, wherein the compositions of the medium is set at the beginning of the fermentation and is not subject to artificial alternations during the fermentation. A variation of the batch system is a "fed-batch fermentation" which also finds use in the present invention. In this variation, the substrate is added in increments as the fermentation progresses. Fed-batch systems are useful when catabolite repression is likely to inhibit the metabolism of the cells and where it is desirable to have limited amounts of substrate in the medium. Batch and fed-batch fermentations are common and well known in the art. "Continuous fermentation" is an open system where a defined fermentation medium is added continuously to a bioreactor and an equal amount of conditioned medium is removed simultaneously for processing. Continuous fermentation generally maintains the cultures at a constant high density where cells are primarily in log phase growth. Continuous fermentation systems strive to maintain steady state growth conditions. Methods for modulating nutrients and growth factors for continuous fermentation processes as well as techniques for maximizing the rate of product formation are well known in the art of industrial microbiology.

In some embodiments of the present invention, cell-free transcription/translation systems find use in producing variant transglutaminase(s). Several systems are commercially available and the methods are well-known to those skilled in the art.

The present invention provides methods of making variant transglutaminase polypeptides or biologically active fragments thereof. In some embodiments, the method comprises: providing a host cell transformed with a polynucleotide encoding an amino acid sequence that comprises at least about 70% (or at least about 75%, at least about 80%, at least about 85%, at least about 90%, at least about 95%, at least about 96%, at least about 97%, at least about 98%, or at least about 99%) sequence identity to SEQ ID NO: 2, 6, 34, and/or 256, and comprising at least one mutation as provided herein; culturing the transformed host cell in a culture medium under conditions in which the host cell expresses the encoded variant transglutaminase polypeptide; and optionally recovering or isolating the expressed variant transglutaminase polypeptide, and/or recovering or isolating the culture medium containing the expressed variant transglutaminase polypeptide. In some embodiments, the methods further provide optionally lysing the transformed host cells after expressing the encoded transglutaminase polypeptide and optionally recovering and/or isolating the expressed variant transglutaminase polypeptide from the cell lysate. The present invention further provides methods of making a variant transglutaminase polypeptide comprising cultivating a host cell transformed with a variant transglutaminase polypeptide under conditions suitable for the production of the variant transglutaminase polypeptide and recovering the variant transglutaminase polypeptide. Typically, recovery or isolation of the transglutaminase polypeptide is from the host cell culture medium, the host cell or both, using protein recovery techniques that are well known in the art, including those described herein. In some embodiments, host cells are harvested by centrifugation, disrupted by physical or chemical means, and the resulting crude extract retained for further purification. Microbial cells employed in expression of proteins can be disrupted by any convenient method, including, but not limited to freeze-thaw cycling, sonication, mechanical disruption, and/or use of cell lysing agents, as well as many other suitable methods well known to those skilled in the art.

Engineered transglutaminase enzymes expressed in a host cell can be recovered from the cells and/or the culture medium using any one or more of the techniques known in the art for protein purification, including, among others, lysozyme treatment, sonication, filtration, salting-out, ultracentrifugation, and chromatography. Suitable solutions for lysing and the high efficiency extraction of proteins from bacteria, such as E. coli, are commercially available under the trade name CelLytic B™ (Sigma-Aldrich). Thus, in some embodiments, the resulting polypeptide is recovered/isolated and optionally purified by any of a number of methods known in the art. For example, in some embodiments, the polypeptide is isolated from the nutrient medium by conventional procedures including, but not limited to, centrifugation, filtration, extraction, spray-drying, evaporation, chromatography (e.g., ion exchange, affinity, hydrophobic interaction, chromatofocusing, and size exclusion), or precipitation. In some embodiments, protein refolding steps are used, as desired, in completing the configuration of the mature protein. In addition, in some embodiments, high performance liquid chromatography (HPLC) is employed in the final purification steps. For example, in some embodiments, methods known in the art, find use in the present invention (See e.g., Parry et al., Biochem. J., 353:117 [2001], and Hong et al., Appl. Microbiol. Biotechnol., 73:1331 [2007], both of which are incorporated herein by reference). Indeed, any suitable purification methods known in the art find use in the present invention.

Chromatographic techniques for isolation of the transglutaminase polypeptide include, but are not limited to reverse phase chromatography high performance liquid chromatography, ion exchange chromatography, gel electrophoresis, and affinity chromatography. Conditions for purifying a particular enzyme will depend, in part, on factors such as net charge, hydrophobicity, hydrophilicity, molecular weight, molecular shape, etc., are known to those skilled in the art.

In some embodiments, affinity techniques find use in isolating the improved transglutaminase enzymes. For affinity chromatography purification, any antibody which specifically binds the transglutaminase polypeptide may be used. For the production of antibodies, various host animals, including but not limited to rabbits, mice, rats, etc., may be immunized by injection with the transglutaminase. The transglutaminase polypeptide may be attached to a suitable carrier, such as BSA, by means of a side chain functional group or linkers attached to a side chain functional group.

Various adjuvants may be used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanin, dinitrophenol, and potentially useful human adjuvants such as BCG (*Bacillus* Calmette Guerin) and *Corynebacterium parvum*.

In some embodiments, the transglutaminase variants are prepared and used in the form of cells expressing the enzymes, as crude extracts, or as isolated or purified preparations. In some embodiments, the transglutaminase variants are prepared as lyophilisates, in powder form (e.g., acetone powders), or prepared as enzyme solutions. In some embodiments, the transglutaminase variants are in the form of substantially pure preparations.

In some embodiments, the transglutaminase polypeptides are attached to any suitable solid substrate. Solid substrates include but are not limited to a solid phase, surface, and/or membrane. Solid supports include, but are not limited to organic polymers such as polystyrene, polyethylene, polypropylene, polyfluoroethylene, polyethylencoxy, and polyacrylamide, as well as co-polymers and grafts thereof. A solid support can also be inorganic, such as glass, silica, controlled pore glass (CPG), reverse phase silica or metal, such as gold or platinum. The configuration of the substrate can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location. A plurality of supports can be configured on an array at various locations, addressable for robotic delivery of reagents, or by detection methods and/or instruments.

In some embodiments, immunological methods are used to purify transglutaminase variants. In one approach, antibody raised against a variant transglutaminase polypeptide (e.g., against a polypeptide comprising any of SEQ ID NO: 2, 6, 34, and/or 256 and/or an immunogenic fragment thereof) using conventional methods is immobilized on beads, mixed with cell culture media under conditions in which the variant transglutaminase is bound, and precipitated. In a related approach, immunochromatography finds use.

In some embodiments, the variant transglutaminases are expressed as a fusion protein including a non-enzyme portion. In some embodiments, the variant transglutaminase sequence is fused to a purification facilitating domain. As used herein, the term "purification facilitating domain" refers to a domain that mediates purification of the polypeptide to which it is fused. Suitable purification domains include, but are not limited to metal chelating peptides, histidine-tryptophan modules that allow purification on immobilized metals, a sequence which binds glutathione (e.g., GST), a hemagglutinin (HA) tag (corresponding to an epitope derived from the influenza hemagglutinin protein; See e.g., Wilson et al., Cell 37:767 [1984]), maltose binding protein sequences, the FLAG epitope utilized in the FLAGS extension/affinity purification system (e.g., the system available from Immunex Corp), and the like. One expression vector contemplated for use in the compositions and methods described herein provides for expression of a fusion protein comprising a polypeptide of the invention fused to a polyhistidine region separated by an enterokinase cleavage site. The histidine residues facilitate purification on IMIAC (immobilized metal ion affinity chromatography; See e.g., Porath et al., Prot. Exp. Purif., 3:263-281 [1992]) while the enterokinase cleavage site provides a means for separating the variant transglutaminase polypeptide from the fusion protein. pGEX vectors (Promega) may also be used to express foreign polypeptides as fusion proteins with glutathione S-transferase (GST). In general, such fusion proteins are soluble and can easily be purified from lysed cells by adsorption to ligand-agarose beads (e.g., glutathione-agarose in the case of GST-fusions) followed by elution in the presence of free ligand.

EXPERIMENTAL

Various features and embodiments of the disclosure are illustrated in the following representative examples, which are intended to be illustrative, and not limiting.

In the experimental disclosure below, the following abbreviations apply: ppm (parts per million); M (molar); mM (millimolar), uM and µM (micromolar); nM (nanomolar); mol (moles); gm and g (gram); mg (milligrams); ug and µg (micrograms); L and l (liter), ml and mL (milliliter): cm (centimeters); mm (millimeters), um and µm (micrometers): sec. (seconds): min(s) (minute(s)); h(s) and hr(s) (hour(s)); U (units); MW (molecular weight); rpm (rotations per minute); ° C. (degrees Centigrade); RT (room temperature); CDS (coding sequence); DNA (deoxyribonucleic acid); RNA (ribonucleic acid); aa (amino acid): TB (Terrific Broth: 12 g/L bacto-tryptone, 24 g/L yeast extract, 4 mL/L glycerol, 65 mM potassium phosphate, pH 7.0, 1 mM $MgSO_4$); LB (Luria Bertani broth); CAM (chloramphenicol); PMBS (polymyxin B sulfate); IPTG (isopropyl thiogalactoside); PEG (polyethylene glycol); TFA (trifluoroacetic acid); CHES (2-cyclohexylamino)ethanesulfonic acid; acetonitrile (MeCN); dimethylsulfoxide (DMSO); dimethylacetamide (DMAc); HPLC (high performance liquid chromatography); UPLC (ultra performance liquid chromatography); FIOPC (fold improvement over positive control); HTP (high throughput); MWD (multiple wavelength detector); UV (ultraviolet); Codexis (Codexis. Inc., Redwood City, Calif.); Sigma-Aldrich (Sigma-Aldrich, St. Louis, Mo.); Millipore (Millipore, Corp., Billerica Mass.); Difco (Difco Laboratories, BD Diagnostic Systems, Detroit, Mich.); GeneOracle (GeneOracle, Santa Clara, Calif.); Boca Scientific (Boca Scientific, Ind., Boca Raton, Fla.); Pall (Pall Corporation, Port Washington, N.Y.); Vivaproducts (Vivaproducts, Inc., Littleton, Mass.); Thermotron (Thermotron, Inc., Holland, Mich.) Infors (Infors USA, Inc., Annapolis Junction, Md.); Genetix (Genetix USA Inc., Beaverton, Oreg.); Daicel (Daicel, West Chester, Pa.); Genetix (Genetix USA, Inc., Beaverton, Oreg.); Molecular Devices (Molecular Devices, LLC, Sunnyvale, Calif.); Applied Biosystems (Applied Biosystems, part of Life Technologies, Corp., Grand Island, N.Y.); Life Technologies (Life Technologies, Corp., Grand Island, N.Y.); Agilent (Agilent Technologies, Inc., Santa Clara, Calif.); Thermo Scientific (part of Thermo Fisher Scientific, Waltham, Mass.); (Infors: Infors-HT, Bottmingen/Basel, Switzerland); Corning (Corning, Inc., Palo Alto, Calif.); and Bio-Rad (Bio-Rad Laboratories, Hercules, Calif.); Microfluidics (Microfluidics Corp., Newton, Mass.); Waters (Waters Corp., Milford, Mass.).

Example 1

Wild Type Streptomyces mobaraensis Transglutaminase (MTG) Gene Acquisition and Construction of Expression Vector A pro-gene coding for Streptomyces mobaraensis transglutaminase (MTCG) was codon optimized for expression in B. megaterium based on the reported amino acid sequence (Shimonishi et al., J. Biol. Chem., 268:11565-115720 [1993]). The gene was synthesized by GenOracle and codon-optimized using their proprietary software. The DNA was sequence verified. The pro-MTG gene was cloned behind a B. megaterium "optimized" signal peptide plus a spacer region (6 bases encoding amino acid residues threonine and serine into an E. coli/B. megaterium shuttle vector pSSBm, using the BsrGI/NgoMIV cloning sites. The vector pSSBm is a modified vector based on the shuttle vector pMMI525 (Boca Scientific). The signal peptide and pro-gene were under the control of an xlyose promoter (Pxyl) regulated by the xylose repressor gene (xylR) present on the shuttle vector. The vector contained the 'rep U' origin of replication for Bacillus and a tetracycline ampicillin resistance marker. The vector also contained the pBR322 origin of replication and an ampicillin resistance marker for maintenance in E. coli. The resulting plasmid (pSSBm-pre-pro-MTG) was transformed by a standard PEG-mediated method of DNA transfer into B. megaterium protoplasts. The pre-pro-MTG sequence from the transformants was verified. The polynucleotide sequence of the pre-pro-MTG that includes a B. megaterium signal peptide was cloned into the shuttle pSSBm vector and the sequence is provided in SEQ ID NO: 6, the sequence of the pro-MTG with a C-terminus histidine purification tag comprises SEQ ID NO: 2 and the sequence of the mature MTG comprises SEQ ID NO: 4.

Example 2

B. megaterium Shake Flask Procedure

A single microbial colony of B. megaterium containing a plasmid with the pre-pro-MTG gene was inoculated into 3 ml Luria-Bertani (LB) broth (0.01 g/L peptone from casein, 0.005 g/L yeast extract, 0.01 g/L sodium chloride) containing 10 µg/mL tetracycline. Cells were grown overnight for at least 16 hrs, at 37° C., with shaking at 250 rpm. The culture was then diluted into 100 mL A5 media (2 g/L $(NH4)_2SO_4$, 3.5 g/L $KH_2HPO_4$, 7.3 g/L $Na_2HPO_4$, 1 g/L yeast extract, pH to 6.8), 100 µL of trace elements solution (49 g/L $MnCl_2.4H_2O$, 45 g/L $CaCl_2$, 2.5 g/L $(NH_4)Mo_7.O_{24}.H_2O$, 2.5 g/L $CoCl_2.6H_2O$), 1.5 mL of 20% glucose, 150 g/L of IM $MgSO_4$, 100 µL of 10 mg/mL tetracycline, 100 µL of 2.5 g/L $FeSO_4.7H_2O$ in a 1000 ml flask to an optical density at 600 nm ($OD_{600}$) of 0.2 and allowed to grow at 37° C. Expression of the pre-pro-MTG gene was induced with 0.5% xylose (final concentration) when the $OD_{600}$ of the culture was 0.6 to 0.8 and incubated overnight, for at least 16 hrs. Cells were pelleted by centrifugation (4000 rpm, 15 min, 4° C.). The clear media supernatant containing the secreted mature MTG enzyme was collected and 60 mL of the supernatant transferred into the top cell of a Jumbosep concentrator (PES membrane, 3,000 MWCO pore size; Pall). The supernatant was centrifuged at room temperature, 4000 rpm, until the volume became less than 20 mL (~45 min). The filtrate was discarded and the remaining 20 mL of supernatant were added to the concentrate to make up a final volume of 40 mL. The centrifugation of the 40 mL was continued at room temperature, 4000 rpm until the volume reached ~20 mL (~45 min). The 20 mL of 5× concentrate were transferred into a Vivaspin 20 concentrator (PES membrane, 10,000 MWCO pore size, Vivaproducts), and centrifuged until the volume was ~1 mL (~60 min). Then, 50 mM NaOAc buffer, pH=5.0 was added up to 20 mL volume (first buffer exchange), and centrifugation continued at room temperature, 4000 rpm until the volume was ~1 mL (~60 min). Then, 50 mM NaOAc buffer pH=5.0 was added up to 20 mL volume (second buffer exchange), and centrifugation continued at room temperature, 4000 rpm until the volume was ~5 mL (~60 min). The 20× concentrate was mixed well and stored and stored at −20° C. MTG activity was confirmed using the hydroxymate assay and the insulin assays described herein.

Example 3

B. megaterium High Throughput Assays to Identify Improved MTG Variants

Plasmid libraries containing variant pre-pro-MTG genes were transformed into B. megaterium and plated on Luria-Bertani (LB) agar plates containing 3 µg/mL tetracycline with a DM3 regeneration media (400 mM sodium succinate dibasic, pH 7.3, 0.5% casamino acids, 0.5% yeast extract, 0.4% $K_2HPO_4$, 0.2% $KH_2PO_4$, 20 mM $MgCl_2$, 0.5% glucose and 0.2% BSA) overlay. After incubation for at least 18 hours at 30° C., colonies were picked using a Q-bot® robotic colony picker (Genetix) into shallow, 96-well well microtiter plates containing 180 µL LB and 10 µg/mL tetracycline. Cells were grown overnight at 37° C. with shaking at 200 rpm and 85% humidity. Then, 20 µL of this culture were transferred into 96-well microtiter plates (deep well) containing 380 µL of subculture media (A5 0.3% glucose medium, as described in Example 2), with 10 µg/mL tetracycline, 1% xylose and 0.25 mM $ZnSO_4$. The plates were then incubated at 37° C. with shaking at 250 rpm and 85% humidity for approximately 15-18 hours. These plates were then centrifuged at 4000 rpm for 15 minutes and the clear media supernatant containing the secreted mature MTG enzyme was used for the high throughput hydroxymate assay.

Example 4

E. coli Expression Hosts Containing Recombinant TG Genes

The initial transglutaminase (TG) parent enzyme (SEQ ID NO: 6) of the present invention was codon optimized for expression in E. coli, synthesized and cloned into a pCK 110900 vector (See e.g., See, U.S. Pat. No. 7,629,157 and US Pat. Appln. Publn. 2016/0244787, both of which are hereby incorporated by reference in their entireties and for all purposes) operatively linked to the lac promoter under control of the lacI repressor. The expression vector also contains the P15a origin of replication and a chloramphenicol resistance gene. The resulting plasmids were transformed into E. coli W3110, using standard methods known in the art. The transformants were isolated by subjecting the cells to chloramphenicol selection, as known in the art (See e.g., U.S. Pat. No. 8,383,346 and WO2010/144103, both of which are incorporated by reference herein, in their entirety).

Example 5

Preparation of HTP TG-Containing Wet Cell Pellets

E. coli cells containing recombinant TG-encoding genes from monoclonal colonies were inoculated into the wells of 96 well shallow-well microtiter plates containing 180 µl LB containing 1% glucose and 30 µg/mL chloramphenicol in each well. The plates were sealed with $O_2$-permeable seals and cultures were grown overnight at 30° C., 200 rpm and 85% humidity. Then, 10 µl of each of the cell cultures were transferred into the wells of 96-well deep-well plates containing 390 mL TB and 30 µg/mL CAM. The deep-well plates were sealed with $O_2$-permeable seals and incubated at 30° C., 250 rpm and 85% humidity until an $OD_{600}$ of 0.6-0.8 was reached. The cell cultures were then induced by IPTG to a final concentration of 1 mM and incubated overnight under the same conditions as originally used. The cells were then pelleted using centrifugation at 4000 rpm for 10 min. The supernatants were discarded and the pellets frozen at −80° C. prior to lysis.

To lyse the cells, 225 µl lysis buffer containing 20 mM Tris-HCl buffer, pH 7.5, 1 mg/mL lysozyme, and 0.5 mg/mL PMBS was added to the cell paste. The cells were incubated at room temperature for 2 hours with shaking on a bench top shaker. The plate was then centrifuged for 15 minutes at 4000 rpm and 4° C. and the clear supernatants were used in subsequent steps.

To activate the pro-enzyme to the mature enzyme, 2 mg/mL of dispase in 60 uL of 50 mM Tris-HCl buffer, pH 8.0 was added to 175 uL of above E. coli supernatant and incubated for 1 hour at 37° C.

Example 6

HTP Purification of TG Variants

HTP purification of the activated lysate was carried out in HisPur™ Ni-NTA spin plate (Life Technologies, cat #88230) using manufacturer's protocol, with modifications, as described. First, 225 uL of dispase activated lysate obtained as described in Example 5 was diluted by an equal volume of binding buffer containing 50 mM Na phosphate, pH 7.5, 300 mM NaCl, and 10 mM imidazole. Then, 165 uL of the diluted lysate was applied to HisPur™ Ni-NTA spin plate pre-equilibrated in the binding buffer and incubated for 10 min at room temperature followed by centrifugation. This step was repeated once. The spin plate was then washed with 600 uL of washing buffer composed of 50 mM Na phosphate, pH 7.5, 300 mM NaCl. and 25 mM imidazole. The purified enzyme was then eluted in 105 uL of elution buffer containing 50 mM Na phosphate, pH 7.5, 300 mM NaCl, and 250 mM imidazole.

Example 7

Preparation of Lyophilized Lysates from Shake Flask (SF) Cultures

Selected HTP cultures grown as described above were plated onto LB agar plates with 1% glucose and 30 µg/ml CAM, and grown overnight at 37° C. A single colony from each culture was transferred to 6 ml of LB with 1% glucose and 30 µg/ml CAM. The cultures were grown for 18 h at 30° C., 250 rpm, and subcultured approximately 1:50 into 250 ml of TB containing 30 µg/ml CAM, to a final $OD_{600}$ of 0.05. The cultures were grown for approximately 195 minutes at 30° C., 250 rpm, to an $OD_{600}$ between 0.6-0.8 and induced with 1 mM IPTG. The cultures were then grown for 20 h at 30° C., 250 rpm. The cultures were centrifuged 4000 rpm×20 min. The supernatant was discarded, and the pellets were resuspended in 30 ml of 20 mM Tris-HCl, pH 7.5. The cells were pelleted (4000 rpm×20 min) and frozen at −80° C. for 120 minutes. Frozen pellets were resuspended in 30 ml of 20 mM TRIS-HCl pH 7.5, and lysed using a Microfluidizer® processor system (Microfluidics) at 18,000 psi. The lysates were pelleted (10,000 rpm×60 min) and the supernatants were frozen and lyophilized to generate shake flake (SF) enzymes.

Example 8

Improvements in Activity of Transglutaminase Expressed by *B. megaterium*

HTP *B. megaterium* cell pellets obtained as described in Example 3 were centrifuged for 15 minutes at 4000 rpm and 4° C. and the clear media supernatants were used in subsequent biocatalytic reactions. HTP reactions were carried out in 96 well deep well plates containing 100 μL of 0.2 M Tris-HCl. pH 8.0, 0.04 M glutamyl donor substrate Z-Gln-Gly (Sigma, C6154), 0.1 M hydroxylamine, 0.01 M glutathione, and 5 μl HTP *B. megaterium* culture lysate supernatant. The HTP plates were incubated in a Thermotron® titre-plate shaker (3 mm throw, model # AJ185, Infors) at 37° C., 100 rpm, for 35 min. The reactions were quenched with 100 μl 0.8 M HCl containing 0.3 M trichloraacetic acid and 2 M $FeCl_3 \cdot 6H_2O$. Absorbance of the samples was recorded at 525 nm.

The fold improvement over positive control (FIOPC) was calculated as the absorbance of the product normalized by the absorbance of the corresponding backbone under the specified reaction conditions. The results are shown in Table 8.1, below.

TABLE 8.1

Transglutaminase HTP Activity Results

| SEQ ID NO: (nt/aa) | Amino Acid Differences (Relative to SEQ ID NO: 6) | Activity Improvement (FIOP)[†] on Glutathione |
|---|---|---|
| 7/8 | G327R | ++ |
| 9/10 | Y101G/Q201K/R212K/S287G | ++ |
| 11/12 | Y101G/S287G | ++ |
| 13/14 | S79K | ++ |
| 15/16 | Y101G/Q201K/R285Q | ++ |
| 17/18 | Y101G | ++ |

[†]Levels of increased activity or selectivity were determined relative to the reference polypeptide of SEQ ID NO: 6, and defined as follows: "+" > than 1.2-fold but less than 1.5-fold increase; "++" > than 1.5-fold but less than 2-fold; "+++" > than 2-fold.

Example 9

Improvements in Activity Trasglutaminase Expressed in *E. coli*

Libraries of the parent enzyme (SEQ ID NO: 2) containing engineered genes were produced using well established techniques known in the art (e.g. saturation mutagenesis and recombination of previously identified beneficial mutations). The polypeptides encoded by each gene were produced in HTP as described in Example 4 and the soluble lysate was generated as described in Example 5.

The following assays were used to evaluate the activity of these variant polypeptides.

Assay A: Glutathione Assay

HTP reactions were carried out in 96-well deep-well plates containing 100 μL of 0.2 M Tris-HCl. pH 8.0, 0.04 M Z-Gln-Gly, 0.1 M hydroxylamine, 0.01 M glutathione, and 10 uL of activated lysate supernatant. The HTP plates were incubated in a Thermotron titre-plate shaker (3 mm throw, model # AJ185, Infors) at 37° C., 300 rpm, for 30 min. The reactions were quenched with 100 μl of quenching solution containing 0.8 M HCl, 0.3 M trichloroacetic acetate, and 2 M $FeCl_3 \cdot 6H_2O$, mixed for 10 minutes using a bench top shaker. The plates were then centrifuged at 4000 rpm for 5 minutes and absorbance at 525 nm recorded. The fold improvement over positive control (FIOPC) was calculated as the UV signal of the variants normalized by that of the corresponding backbone under the specified reaction conditions.

Assay B: Insulin Assay

HTP reactions were carried out in 96-well deep-well plates containing 200 μL of 0.1 M Tris-HCl, pH 8.0, 1 g/L insulin, 25 mM EDTA, 1.25 mM Z-Gin-donor substrate, and 70 uL of purified lysate as described in Example 6. The HTP plates were incubated in a Thermotron® titre-plate shaker (3 mm throw, model # AJ185, Infors) at 30° C., 300 rpm, for 24 hours. The reactions were quenched with 200 μl DMSO and mixed for 5 minutes using a bench top shaker. The plates were then centrifuged at 4000 rpm for 5 minutes, and the supernatants loaded into LC-MS for analysis. The LC-MS and UV signals were both collected. The fold improvement over positive control (FIOPC) was calculated as the UV signal of the modified insulin in variants normalized by that of the corresponding backbone under the specified reaction conditions.

TABLE 9.1

Assay Results for Transglutaminase Variants

| SEQ ID NO: (nt/aa) | Amino Acid Differences (Relative to SEQ ID NO: 2) | Activity Improvement (FIOP)[†] on Glutatione (Assay A) | Activity Improvement (FIOP)[‡] on Insulin (Assay B) |
|---|---|---|---|
| 19/20 | S48K/G203L/G296L/N343R/E346H/K373M | | ++++ |
| 21/22 | S48K/Q170K/G203L/E346H/K373M | ++ | ++++ |
| 23/24 | S48K/Q170K/G203L/R254Q/E346H | ++ | ++++ |
| 25/26 | S48K/G203L/N343R/E346H/K373M | + | ++++ |
| 27/28 | S48K/G203L/R254Q/E346H/K373M | +++ | ++++ |
| 29/30 | S48K/Q170K/G203L/N343R/E346H | | ++++ |
| 31/32 | S48K/Q170K/G203L/G296L/N343R/E346H | | ++++ |
| 33/34 | S48K/G203L/N343R/E346H | | ++++ |
| 35/36 | N343R/E346H/K373M | | ++++ |
| 37/38 | S48K/Q170K/G203L/G296L/E346H/K373M | +++ | ++++ |
| 39/40 | S48K/G203L/G296L/E346H/K373M | +++ | ++++ |
| 41/42 | S48K/Q170K/G203L/R254Q/G296L/E346H/K373M | +++ | ++++ |
| 43/44 | S48K/G203L/E346H | ++ | ++++ |
| 45/46 | S48K/Q170K/G203L/R254Q/E346H/K373M | | ++++ |
| 47/48 | S48K/G203L/E346H/K373M | | ++++ |
| 49/50 | S48K/Q170K/G203L/R254Q/G296L/E346H | ++ | ++++ |
| 51/52 | G203L/N343R/E346H | | ++++ |
| 53/54 | S48K/Q170K/G296L/N343R/E346H | | ++++ |
| 55/56 | S48K/G203L/R254Q/E346H | ++ | ++++ |
| 57/58 | S48K/G203L/R254Q/G296L/E346H/K373M | +++ | ++++ |
| 59/60 | S48K/Q170K/G203L/E346H | ++ | ++++ |
| 61/62 | S48K/G203L/G296L/E346H | | ++++ |
| 63/64 | S48K/N343R/E346H | | ++++ |
| 65/66 | S48K/R254Q/E346H | | ++++ |
| 67/68 | S48V/R67E/G203V/S256G/G296R/K373V | +++ | +++ |
| 69/70 | S48K/Q170K/N343R/E346H | | +++ |
| 71/72 | Q170K/G203L/N343R/E346H | | +++ |
| 73/74 | Q170K/G203L/R254Q/G296L/N343R/E346H | ++ | +++ |
| 75/76 | G203L/E346H | | +++ |
| 77/78 | S48V/R67E/Y70G/S256G/G296R/S345E/K373V | +++ | +++ |

TABLE 9.1-continued

Assay Results for Transglutaminase Variants

| SEQ ID NO: (nt/aa) | Amino Acid Differences (Relative to SEQ ID NO: 2) | Activity Improvement (FIOP)† on Glutatione (Assay A) | Activity Improvement (FIOP)‡ on Insulin (Assay B) |
|---|---|---|---|
| 79/80 | S48K/G203L/R254Q/G296L/N343R/K373M | +++ | +++ |
| 81/82 | F297W/E346A | | +++ |
| 83/84 | S48V/S256G/G296R | ++ | +++ |
| 85/86 | P68A/R282K/F297W/E346A | | +++ |
| 87/88 | F136Y/P215N/H234Y/F297W/E346A | | +++ |
| 89/90 | P68A/E74T/S190G/P215N/E346A | | +++ |
| 91/92 | E74T/F136Y/E346A | | +++ |
| 93/94 | P215N/H234Y/F297W/E346A | | +++ |
| 95/96 | G203L/N343R | ++ | ++ |
| 97/98 | S48V/R67E/Y70G/G203V/S256G/G296R/S345E | +++ | ++ |
| 99/100 | F136Y/S190G/P215N/F297W/E346A | | ++ |
| 101/102 | E74T/E346A | | ++ |
| 103/104 | Q170K/G203L/R254Q/N343R/K373M | ++ | ++ |
| 105/106 | S48V/G296R/K373V | ++ | ++ |
| 107/108 | P68A/F297W/E346A | | ++ |
| 109/110 | P68A/V158I/E174D/H234Y/R282K/F297W/E346A | | ++ |
| 111/112 | E174D/R282K/F297W/E346A | | ++ |
| 113/114 | E74T/F136Y/E174D/F297W/E346A | | ++ |
| 115/116 | E74T/S255R/E346A | | ++ |
| 117/118 | E174D/P215N/H234Y/F297W/E346A | | ++ |
| 119/120 | S48V/R67E/Y70G/R181K/G296R/S345E/K373V | +++ | ++ |
| 121/122 | P215H/S255R/F297W/E346A | | ++ |
| 123/124 | P215N/S255R/F297W/E346A | | ++ |
| 125/126 | S48K/G203L/G296L/N343R/K373M | +++ | ++ |
| 127/128 | S48V/R181K/G296R | + | ++ |
| 129/130 | P68A/F136Y/P215N/F297W/E346A | | ++ |
| 131/132 | P215N/E346A | | ++ |
| 133/134 | S190G/F297W/E346A | | ++ |
| 135/136 | F136Y/F297W/E346A | | ++ |
| 137/138 | E174D/S190G/H234Y/F297W/E346A | | ++ |
| 139/140 | S48V/R67E/Y70G/R181K/G203V/S256G | +++ | ++ |
| 141/142 | E74T/F136Y/E174D/R282K/E346A | | ++ |
| 143/144 | S255R/F297W/E346A | | ++ |
| 145/146 | F136Y/E174D/P215N/S255R/R282K/F297W/E346A | | ++ |
| 147/148 | V158I/P215N/S255R/E346A | ++ | ++ |
| 149/150 | P215N/F297W/E346A | | ++ |
| 151/152 | P68A/V158I/P215N/F297W/E346A | | ++ |
| 153/154 | F136Y/V158I/P215N/F297W/E346A | | ++ |
| 155/156 | H234Y/S255R/E346A | | ++ |
| 157/158 | S255R/E346A | | ++ |
| 159/160 | E346A | | ++ |
| 161/162 | F136Y/V158I/S190G/P215N/S255R/F297W/E346A | | ++ |
| 163/164 | F136Y/P215N/F297W | | ++ |
| 165/166 | P68A/F136Y/P215N/S255R/R282K/F297W/E346A | | ++ |
| 167/168 | P68A/P215N/F297W/E346A | | ++ |
| 169/170 | S48K/Y70L/G203L/R254Q/G296L/N343R | +++ | ++ |
| 171/172 | S48V/G203V/S256G | ++ | ++ |
| 173/174 | S190G/S255R/R282K/E346A | | ++ |
| 175/176 | S48K/G203L/R254Q/G296L | +++ | ++ |
| 177/178 | S48V/R67E/G203V/S256G/S345E | ++ | ++ |
| 179/180 | V158I/P215N/E346A | | ++ |
| 181/182 | S48V/G203V/S256G/G296R/S345E | | ++ |
| 183/184 | S48V/Y70G/G203V/K373V | ++ | ++ |
| 185/186 | S48V/Y70G/G203V/S256G/S345E/K373V | +++ | ++ |
| 187/188 | S48V/R67E/Y70G | ++ | ++ |
| 189/190 | S48K/G203L | ++ | ++ |
| 191/192 | E174D/P215N/S255R/F297W/E346A | | ++ |
| 193/194 | S48V/R181K/S256G/G296R/S345E | | ++ |
| 195/196 | S48V/R67E/Y70G/G203V/S345E | ++ | ++ |
| 197/198 | S48V/R67E/Y70G/R181K/S256G/S345E | ++ | ++ |
| 199/200 | S48V/R67E/Y70N/S256G | ++ | ++ |
| 201/202 | S48K/Q170K/G203L/K373M | ++ | ++ |
| 203/204 | S48V/G203V | | ++ |
| 205/206 | S48V/R181K/G296R/S345E | | ++ |
| 207/208 | R67E/G296R/S345E | ++ | ++ |
| 209/210 | S48V | | ++ |
| 211/212 | S48V/S256G/G296R/S345E | | ++ |
| 213/214 | S48V/R67E/Y70N/G203V/S256G/S345E/G354H/K373L | +++ | ++ |
| 215/216 | S48K/Q170K/G203L | + | ++ |
| 217/218 | F136Y/P215N/H234Y/R282K/F297W | | ++ |
| 219/220 | S48V/R181K | | ++ |
| 221/222 | S48K/R254Q/G296L | ++ | ++ |
| 223/224 | R67E/S256G | + | ++ |
| 225/226 | S48K/Q170K/G296L | + | + |
| 227/228 | E74T/V158I/S255R/F297W | | + |
| 229/230 | S48V/G296R/S345E | | + |
| 231/232 | S48V/S256G | | + |
| 233/234 | P68A/H234Y | ++ | + |
| 235/236 | S48V/R181K/G203V/S256G/S345E | ++ | + |
| 237/238 | S48K/Q170K/R254Q | | + |
| 239/240 | S48K/Y70D/Q170K/G203L | ++ | + |
| 241/242 | S48V/G203V/S345E | | + |
| 243/244 | G203L/G296L | ++ | + |
| 245/246 | P68A/F136Y/H234Y | | + |
| 247/248 | S48V/S345E/K373L | | + |
| 249/250 | S48V/Y70N/G203V/S256G/S345E | ++ | + |
| 251/252 | P215N/F297W | | + |
| 253/254 | S48V/R181K/G203V/S345E | | + |

†Levels of increased activity or selectivity were determined relative to the reference polypeptide of SEQ ID NO: 2. and defined as follows: "+" > than 1.2-fold but less than 1.5-fold increase: "++" > than 1.5-fold but less than 2-fold; "+++" > than 2-fold.
‡Levels of increased activity or selectivity were determined relative to the reference polypeptide of SEQ ID NO: 2, and defined as follows: "+" > than 1.2-fold but less than 2.0-fold increase: "++" > than 2.0-fold but less than 5-fold: "+++" > than 5-fold but less than 10-fold; "++++" > than 10-fold.

TABLE 9.2

Transglutaminase Variant Activity Results

| SEQ ID NO: (nt/aa) | Amino Acid Differences (Relative to SEQ ID NO: 2) | Activity Improvement (FTOP)† on Glutathione (Assay A) | Activity Improvement (FIOP)‡ on Insulin (Assay B) |
|---|---|---|---|
| 493/494 | S48K/G203L/R254Q/N343R | + | ++ |
| 495/496 | S48V/R67E/S256G/G296R/K373V/G378D | ++ | ++ |
| 497/498 | S48V/R67E/G203V/G296R/K373V | ++ | ++ |
| 499/500 | S48V/Y70G/G203V/G296R/K373V | ++ | ++ |

TABLE 9.2-continued

Transglutaminase Variant Activity Results

| SEQ ID NO: (nt/aa) | Amino Acid Differences (Relative to SEQ ID NO: 2) | Activity Improvement (FTOP)† on Glutathione (Assay A) | Activity Improvement (FIOP)‡ on Insulin (Assay B) |
|---|---|---|---|
| 501/502 | S48V/Y70G/G203V/S256G/G296R/K373V | ++ | ++ |
| 503/504 | S48V/G203V/S256G/G296R/K373V | ++ | ++ |
| 505/506 | S48V/R67E/S256G/G296R/K373V | ++ | ++ |
| 507/508 | S48V/G203V/G296R/K373V/Q374L | + | ++ |
| 509/510 | S48V/R67E/Y70G/G203V/S256G/G296R/K373V | ++ | ++ |
| 511/512 | S48V/G203V/G296R/K373V | ++ | ++ |
| 513/514 | S48V/R67E/Y70G/R181K/G203V/S256G/G296R/K373V | ++ | ++ |
| 515/516 | S48V/R67E/R181K/G203V/S256G/G296R/K373V | ++ | ++ |
| 517/518 | S48V/Y70G/S256G/G296R/K373V | ++ | ++ |
| 519/520 | S48V/Y70G/R181K/G203V/S256G/G296R/K373V | ++ | ++ |
| 521/522 | S48V/G203V/S256G/G296R | ++ | ++ |
| 523/524 | A36E/S48K/G203L/R254Q/E346H | ++ | ++ |
| 525/526 | S48V/Y70G/G203V/G296R | ++ | ++ |
| 527/528 | S48V/R181K/G203V/G296R | + | ++ |
| 529/530 | S48V/S256G/G296R/K373V | + | ++ |
| 531/532 | S48V/R181K/S256G/G296R/K373V | + | ++ |
| 533/534 | S48V/Y70G/R181K/G203V/G296R/K373V | ++ | ++ |
| 535/536 | S48V/R181K/G203V/S256G/K373V | ++ | ++ |
| 537/538 | G203V/S256G/G296R/K373V | ++ | ++ |
| 539/540 | S48V/R67E/R181K/S256G/G296R | + | ++ |
| 541/542 | G203L/R254Q/N343R/E346H/K373M | + | ++ |
| 543/544 | Y70G/G203V/S256G/G296R/K373V | ++ | ++ |
| 545/546 | R67E/R181K/G203V/S256G/G296R/K373V | ++ | ++ |
| 547/548 | S48V/Y70G/G296R/K373V | + | ++ |
| 549/550 | R67E/Y70G/R181K/G203V/S256G/G296R/K373V | ++ | ++ |
| 551/552 | Y70G/R181K/G203V/G296R/K373V | ++ | ++ |
| 553/554 | S48V/Y70G/G203V/K373V | ++ | ++ |
| 555/556 | S48V/R67E/R181K/G203V/S256G/K373V | ++ | ++ |
| 557/558 | S48V/R67E/G203V/S256G/K373V | ++ | ++ |
| 559/560 | S48V/Y70G/G203V/S256G/K373V | ++ | ++ |
| 561/562 | R181K/G203V/S256G/G296R/K373V | ++ | ++ |
| 563/564 | R67E/G203V/S256G/G296R/K373V | ++ | ++ |
| 565/566 | G203V/G296R/K373V | + | ++ |
| 567/568 | R67E/S256G/G296R/K373V | + | ++ |
| 569/570 | S48V/S256G/K373V | + | ++ |
| 571/572 | R181K/G203V/G296R/K373V | + | ++ |
| 573/574 | S48V/G203V/K373V | + | ++ |
| 575/576 | A33D/R67E/Y70G/R181K/G203V/S256G/G296R/K373V | ++ | ++ |
| 577/578 | S48V/R181K/G203V/K373V | + | ++ |
| 579/580 | S48V/G203V/S256G/K373V | ++ | ++ |
| 581/582 | G203L/R254Q/E346H/K373M | + | ++ |
| 583/584 | R67E/R181K/G203V/S256G/G296R | ++ | ++ |
| 585/586 | G203V/S256G/G296R/K373V/H386Y | + | + |
| 587/588 | G203L/R254Q/E346H | ++ | + |
| 589/590 | S256G/G296R | + | + |
| 591/592 | Y70G/R181K/G203V/S256G/G296R/K373V | ++ | + |
| 593/594 | R67E/T70G/R181K/S256G/G296R/K373V | + | + |
| 595/596 | G203V/S256G/G296R | + | + |
| 597/598 | Y70G/G203V/G296R/K373V | + | + |
| 599/600 | R181K/S256G/G296R/K373V | + | + |
| 601/602 | S48V/Y70G/R181K/G203V/S256G/K373V | ++ | + |
| 603/604 | G203L/P224T/R254Q/K373M | + | + |
| 605/606 | G203V/S256G/K373V | + | + |
| 607/608 | S256G/G296R/K373V | + | + |
| 609/610 | S48V/G203L/R254Q/N343R/E346H/K373M | + | + |
| 611/612 | R181K/G203V/S256G/G296R | + | + |
| 613/614 | S48K/R254Q/N343R/E346H/K373M | + | + |
| 615/616 | R67E/R181K/G203V/S256G/K373V | + | + |
| 617/618 | S48V/K373V | | + |
| 619/620 | S256G/K373V | + | + |
| 621/622 | R254Q/E346H/K373M | + | + |
| 623/624 | S48K/G203L/R254Q/N343R/K373M | ++ | + |
| 625/626 | S48K/G203L/N343R/K373M | + | + |
| 627/628 | R181K/G203V/S256G/K373V | + | + |
| 629/630 | G203V/N209Y/S256G/K373V | + | + |
| 631/632 | R181K/G203V/K373V | + | + |
| 633/634 | G203L/E346H/K373M | + | + |
| 635/636 | G203V/S256G | + | + |
| 637/638 | H234Y/R282K/E346A | + | + |
| 639/640 | Y70G/G203V/S256G/K373V | ++ | + |
| 641/642 | R181K/G203V/S256G | + | + |
| 643/644 | F136Y/P215N/R282K/E346A | + | + |
| 645/646 | G203V/K373V | + | + |
| 647/648 | R67E/Y70G/R181K/K373V | + | |
| 649/650 | R254Q/E346H | + | |
| 651/652 | Y70G/G203V | + | |
| 653/654 | S48K/G203L/R254Q/N343R/A355T/K373M | + | |
| 655/656 | S48K/R254Q/E346H/K373M | + | |
| 657/658 | G203V/S256G/G296R/H320Y/K373V | + | |
| 659/660 | G203L/R254Q/N343R/K373M | ++ | |
| 661/662 | S48K/R254Q/N343R/K373M | + | |
| 663/664 | S48K/G203L/R254Q/E346D/K373M | + | |
| 665/666 | G203L/K373M | + | |
| 667/668 | S48K/R254Q | + | |
| 669/670 | K373M | + | |
| 671/672 | G203L/R254Q/K373M | ++ | |
| 673/674 | S48K/G203L/R254Q | ++ | |
| 675/676 | S48K/G203L/K373M | ++ | |
| 677/678 | S48K/R254Q/K373M | + | |
| 679/680 | R254Q/K373M | + | |
| 681/682 | G203L/R254Q | + | |
| 683/684 | S48K/G203L/R254Q/K373M | ++ | |
| 685/686 | R254Q | + | |
| 687/688 | E74T/F136Y/H234Y/R282K/F297W/E346A | | ++ |
| 689/690 | E74T/F136Y/P215N/H234Y/R282K/F297W/E346A | | ++ |
| 691/692 | E74T/P215N/H234Y/R282K/F297W/E346A | | ++ |
| 693/694 | E74T/F136Y/P215N/R282K/F297W/E346A | | ++ |
| 695/696 | P215N/H234Y/R282K/F297W/E346A | | ++ |
| 697/698 | E74T/F136Y/P215N/H234Y/R282K/E346A | | ++ |
| 699/700 | E74T/F136Y/P215N/H234Y/F297W/E346A | | ++ |

TABLE 9.2-continued

Transglutaminase Variant Activity Results

| SEQ ID NO: (nt/aa) | Amino Acid Differences (Relative to SEQ ID NO: 2) | Activity Improvement (FTOP)† on Glutathione (Assay A) | Activity Improvement (FIOP)‡ on Insulin (Assay B) |
|---|---|---|---|
| 701/702 | E74T/F136Y/R282K/F297W/E346A | | ++ |
| 703/704 | E74T/F136Y/P215N/F297W/E346A | | ++ |
| 705/706 | E74T/P215N/R282K/F297W/E346A | | ++ |
| 707/708 | E74T/F136Y/P215N/H234Y/F297W/N343Y/E346A | | + |
| 709/710 | N343R/K373M | | + |
| 711/712 | E74T/F136Y/P215N/H234Y/E346A | | + |
| 713/714 | S48V/R181K/G203V/S256G/G296R/K373V | | + |
| 715/716 | F136Y/P215N/H234Y/R282K/F297W/E346A | | + |
| 717/718 | F136Y/H234Y/E346A | | + |
| 719/720 | E74T/P215N/E346A | | + |
| 721/722 | E74T/F136Y/P215N/E346A | | + |
| 723/724 | F136Y/H234Y/F297W/E346A | | + |
| 725/726 | F136Y/P215N/R282K/F297W/E346A | | + |
| 727/728 | F136Y/P215N/E346A | | + |
| 729/730 | P215N/H234Y/R282K/E346A | | + |
| 731/732 | F136Y/P215N/F297W/E346A | | + |
| 733/734 | E74T/F136Y/H234Y/E346A | | + |
| 735/736 | R282K/F297W/E346A | | + |
| 737/738 | P215N/H234Y/E346A | | + |
| 739/740 | E74T/F136Y/P215N/R282K/E346A | | + |
| 741/742 | E74T/F136Y/P215N/H234Y/F297W | | + |
| 743/744 | K373V | | + |
| 745/746 | R181K/G296R | | + |
| 747/748 | S48K/A176T/G203L/R254Q/E346H/K373M | | + |
| 749/750 | F136Y/P215N/R282K/F297W | | + |
| 751/752 | F136Y/H234Y/F297W | | + |
| 753/754 | E74T/P215N | | + |
| 755/756 | F136Y/R282K/F297W | | + |

‡Levels of increased activity or selectivity were determined relative to the reference polypeptide of SEQ ID NO: 2. and defined as follows: "+" > than 1.2-fold but less than 2.0-fold increase; "++" > than 2.0-fold but less than 5-fold; "+++" > than 5-fold but less than 10-

Example 10

Activity Improvement in Transglutaminase Variants Expressed in E. coli

Libraries of the parent enzyme (SEQ ID NO: 34) containing engineered genes were produced using well established techniques known in the art (e.g. saturation mutagenesis and recombination of previously identified beneficial mutations). The polypeptides encoded by each gene were produced in HTP as described in Example 4, and the soluble lysate was generated as described in Example 5. HTP reactions were carried out in 96-well deep-well plates containing 200 μL of 0.1 M Tris-HCl, pH 8.0, 1 g/L insulin, 25 mM EDTA, 5 mM lysine donor substrate, and 70 uL of purified lysate as described in Example 6. The HTP plates were incubated in a Thermotron® titre-plate shaker (3 mm throw, model # AJ185, Infors) at 30° C., 300 rpm, for 22 hours. The reactions were quenched with 200 μl DMSO and mixed for 5 minutes using a bench top shaker. The plates were then centrifuged at 4000 rpm for 5 minutes, supernatant loaded into LC-MS for analysis. The fold improvement over positive control (FIOPC) was calculated as the mass of insulin modified with one lysine donor in variants normalized by that of the corresponding backbone under the specified reaction conditions.

TABLE 10.1

Transglutaminase Variant Activity

| SEQ ID NO: (nt/aa) | Amino Acid Differences (Relative to SEQ ID NO: 34) | Activity Improvement (FIOP)‡ on Insulin |
|---|---|---|
| 255/256 | D50R | ++ |
| 257/258 | D50A | ++ |
| 259/260 | L331H | ++ |
| 261/262 | L331P | + |
| 263/264 | D50Q | ++ |
| 265/266 | K48S/D49W | ++ |
| 267/268 | L331V | + |
| 269/270 | D50F | + |
| 271/272 | S292R | + |
| 273/274 | T291C | + |
| 275/276 | S330Y | + |
| 277/278 | L331R | + |
| 279/280 | S330H | + |
| 281/282 | D49Y | + |

‡Levels of increased activity or selectivity were determined relative to the reference polypeptide of SEQ ID NO: 34, and defined as follows: "+" > than 1.2-fold but less than 2.0-fold increase; "++" > than 2.0-fold but less than 5-fold; "+++" > than 5-fold but less than 10-fold, "++++" > than 10-fold.

Example 11

Activity Improvement in Transglutaminase Variants Expressed in E. coli

Libraries of the parent enzyme (SEQ ID NO: 256) containing engineered genes were produced using well established techniques known in the art (e.g., saturation mutagenesis and recombination of previously identified beneficial mutations). The polypeptides encoded by each gene were produced in HTP as described in Example 4, and the soluble lysates were generated as described in Example 5.

HTP reactions were carried out in 96-well deep-well plates containing 200 μL of 0.1 M Tris-HCl, pH 8.0, 2 g/L insulin, 25 mM EDTA, 5 mM lysine donor substrate, 10% acetonitrile, and 70 uL of purified lysate produced as described in Example 6. The HTP plates were incubated in a Thermotron® titre-plate shaker (3 mm throw, model # AJ185, Infors) at 30° C., 300 rpm, for 22 hours. The reactions were quenched with 200 μl DMSO and mixed for 5 minutes using a bench top shaker. The plates were then centrifuged at 4000 rpm for 5 minutes, and supernatants loaded into LC-MS for analysis. The fold improvement over positive control (FIOPC) was calculated as the mass of insulin modified with one lysine donor in variants normalized by that of the corresponding backbone under the specified reaction conditions.

TABLE 11.1

Transglutaminase Variant Assay Results

| SEQ ID NO: (nt/aa) | Amino Acid Differences (Relative to SEQ ID NO: 256) | Activity Improvement (FIOP)‡ on Insulin |
|---|---|---|
| 283/284 | K48S/D49W/R50A/L331V | +++ |
| 285/286 | K48S/D49Y/R50A/T291C/S292R/L331V | +++ |
| 287/288 | K48V/L203V/H234Y/H346A/K373M | +++ |

TABLE 11.1-continued

Transglutaminase Variant Assay Results

| SEQ ID NO: (nt/aa) | Amino Acid Differences (Relative to SEQ ID NO: 256) | Activity Improvement (FIOP)‡ on Insulin |
|---|---|---|
| 289/290 | K48S/D49W/R50A/S292R | ++ |
| 291/292 | K48V/L203V/H234Y/S256G/H346A/K373M | ++ |
| 293/294 | L203V/K373M | ++ |
| 295/296 | K48S/D49W/S330Y/L331V | ++ |
| 297/298 | R67E/Y70G/E74T/P215H/H234Y/F297W/H346A/K373L | ++ |
| 299/300 | K48S/D49W/R50A/S349R | ++ |
| 301/302 | R67E/F297W/H346A | ++ |
| 303/304 | R67E/E74T/P215H/H346A/K373V | ++ |
| 305/306 | R67E/Y70G/E74T/F136Y/L203V/P215H/S256G/H346A/K373M | ++ |
| 307/308 | R67E/P215H/H234Y/F297W/H346A/K373V | ++ |
| 309/310 | K48V/R67E/E74T/H234Y/F297W/H346A/K373M | ++ |
| 311/312 | S292R/S330Y/L331P | ++ |
| 313/314 | R67E/Y70G/E74T/P215H/S256G/K373M | ++ |
| 315/316 | K48S/D49G/R50A/S292R/L331P | ++ |
| 317/318 | K48V/R67E/H346A/K373M | ++ |
| 319/320 | R67E/E74T/P215H/S256G/F297W/H346A/K373L | ++ |
| 321/322 | R67E/Y70G/F136Y/L203V/F297W/H346A/K373M | ++ |
| 323/324 | R67E/Y70G/L203V/P215H/S256G/H346A/K373L | ++ |
| 325/326 | K48V/R67E/Y70G/H234Y/S256G/R282K/F297W/H346A | ++ |
| 327/328 | K48V/R67E/E74T/H346A | ++ |
| 329/330 | N27S/K48V/R67E/Y70G/H346A/K373L | ++ |
| 331/332 | D49W/R50A/L331V | ++ |
| 333/334 | R67E/Y70G/E74T/L203V/P215H/H234Y/H346A/K373V | ++ |
| 335/336 | N27S/K48V/R67E/Y70G/F136Y/L203V/P215H/S256G/R282K/H346A/K373V | ++ |
| 337/338 | R67E/F136Y/L203V/P215H/S256G/H346A/K373V | ++ |
| 339/340 | Y70G/E74T/L203V/P215H/H346A/K373V | ++ |
| 341/342 | R67E/Y70G/P215H | ++ |
| 343/344 | K48V/R67E/Y70G/L203V/P215H/H234Y/S256G/H346A | ++ |
| 345/346 | K48V/R67E/L203V/H346A/K373M | ++ |
| 347/348 | N27S/K48V/R67E/E74T/L203V/S256G/H346A/K373M | ++ |
| 349/350 | R67E/E74T/F136Y | ++ |
| 351/352 | N27S/R67E/H234Y/G296R/K373M | ++ |
| 353/354 | K48V/R67E/P215H/R282K/F297W/H346A/K373M | ++ |
| 355/356 | F136Y/H346A/K373M | ++ |
| 357/358 | R67E/F136Y/L203V/S256G/H346A/K373M | ++ |
| 359/360 | F297W/K373M | ++ |
| 361/362 | K48V/E74T/H234Y/S256G/F297W/H346A/K373V | ++ |
| 363/364 | K48V/Y70G/E74T/F297W/H346A/K373M | ++ |
| 365/366 | K48V/Y70G/P215H/H234Y/S256G/H346A/K373M | ++ |
| 367/368 | N27S/K48V/R67E/Y70G/E74T/H234Y/S256G/R282K/H346A/K373L | ++ |
| 369/370 | K48V/R67E/E74T/L203V/H234Y/S256G/R282K/H346A/K373V | ++ |
| 371/372 | R67E/Y70G/L203V/K373M | ++ |
| 373/374 | R67E/L203V/F297W/H346A/K373M | ++ |
| 375/376 | R67E/E74T/S256G/H346A/K373M | ++ |
| 377/378 | H234Y/H346A/K373M | ++ |
| 379/380 | K48V/Y70G/L203V/P215H/S256G/R282K/H346A/K373V | ++ |
| 381/382 | K48V/F136Y/S256G/H346A/K373M | ++ |
| 383/384 | K48V/S256G/K373L | ++ |
| 385/386 | K48V/P215H/H346A/K373M | ++ |
| 387/388 | K48V/P215H/H234Y/H346A/K373V | ++ |
| 389/390 | K48V/R67E/Y70G/H346A | ++ |
| 391/392 | K48S/D49Y/R50Q/S292R/L331V | ++ |
| 393/394 | S292R/S330Y/L331V | ++ |
| 395/396 | E295R/F297Y/A333P | ++ |
| 397/398 | D49W/R50A/L331V/S349R | ++ |
| 399/400 | K48V/L203V/H234Y/S256G/F297W/H346A/K373V | ++ |
| 401/402 | D49G/R50A/S292R/L331V | ++ |
| 403/404 | K48V/E74T/L203V/H234Y/S256G/H346A/K373V | ++ |
| 405/406 | S292R/S349R | ++ |
| 407/408 | K48V/H234Y/S256G/G296R/H346A/K373M | ++ |
| 409/410 | L203V/H234Y/H346A | ++ |
| 411/412 | D49G/R50Q/S292R/L331V/S349R | ++ |
| 413/414 | S292R/L331V/S349R | ++ |
| 415/416 | S292R | ++ |
| 417/418 | K48V/L203V/G296R/K373M | ++ |
| 419/420 | S330Y/L331P | ++ |
| 421/422 | K48V/R67E/H234Y/S256G/F297W/H346A/K373V | ++ |
| 423/424 | K48A/P287S/S292K/F297Y | ++ |
| 425/426 | K48V/H234Y/S256G/H346A/K373M | ++ |
| 427/428 | K48V/R67E/H234Y/S256G/H346A/K373M | ++ |
| 429/430 | R67E/E74T/L203V/H234Y/S256G | ++ |
| 431/432 | L203V/H234Y/H346A/K373V | ++ |
| 433/434 | R67E/L203V/H234Y/S256G/H346A/K373V | ++ |
| 435/436 | R50A | + |
| 437/438 | A45S/S292K/N328E | + |
| 439/440 | S292R/L331V | + |
| 441/442 | N328E/A333P | + |
| 443/444 | L331V/S349R | + |
| 445/446 | A333P | + |
| 447/448 | L331V | + |
| 449/450 | K48A/P287S/F297Y/N328E/A333P | + |
| 451/452 | K373V | + |
| 453/454 | H346A/K373V | + |
| 455/456 | K48A | + |
| 457/458 | K48A/S292K | + |
| 459/460 | P287S | + |
| 461/462 | K48A/R284G/S292K/A333P | + |
| 463/464 | A45S/P287S/N328E/A333P | + |
| 465/466 | P287S/E295R/F297Y | + |
| 467/468 | P287S/S292K/F297Y | + |
| 469/470 | S292K | + |
| 471/472 | F136Y | + |
| 473/474 | E295R | + |
| 475/476 | K48A/S292K/F297Y | + |
| 477/478 | S292K/F297Y | + |
| 479/480 | F297Y/N328E | + |
| 481/482 | P287S/S292K/E295R/F297Y | + |
| 483/484 | P287S/S330G/A333P | + |
| 485/486 | P287S/S292K | + |
| 487/488 | K373M | + |
| 489/490 | H234Y/R282K | + |
| 491/492 | S330Y | + |

‡Levels of increased activity or selectivity were determined relative to the reference polypeptide of SEQ ID NO: 256, and defined as follows: "+" > than 1.2-fold but less than 2.0-fold increase; "++" > than 2.0-fold but less than 5-fold, "+++" > than 5-fold but less than 10-fold; "++++" > than 10-fold.

Example 12

Analytical Detection of TG Production Formation

Data described in Examples 8-11 were collected using analytical methods in Tables 12.1 or 12.2. LC-MS analysis methods for the product resulting in the modification of insulin by the glutamine Z-donor are provided in Table 12.1. The HTP assay mixtures prepared and formation of the modified insulin product compound detected by LC-MS-UV using the instrumental parameters and conditions shown in Table 12.1. The mass of the product was used to determine the substrate and product peaks and the UV signal was used to quantify each species and compare to the positive control and calculate FIOP.

TABLE 12.1

| Analytical Method | |
|---|---|
| Instrument | Thermo LXQ |
| Column | Waters X-bridge C18 column: 50 × 3.0 mm, 5 um, with Phenomenex C18 guard Cartridge: 5 × 3.0 mm, 5 μm |
| Mobile Phase | Gradient (A: 0.2% formic acid in water; B: 0.2% formic acid in MeCN) |

| Time(min) | % A |
|---|---|
| 0.0 | 75 |
| 1.0 | 75 |
| 4.0 | 70 |
| 5.0 | 5.0 |
| 6.0 | 75 |
| 7.0 | 75 |

| | |
|---|---|
| Flow Rate | 0.7 mL/min |
| Run Time | 7 min |
| Column Temperature | 45° C. |
| Injection Volume | 10 μL |
| MS Detection | LXQ; divert flow from MS between 0-0.5 min. BP extracted ions for: insulin product (+6, +5, +4 species) = 969.2, 1163.0, 1453.0 modified insulin product (+5. +4 species) = 1227.0, 1533.0 |
| MS Conditions | MS Polarity: Positive; Ionization: ESI; Mode: Q1 Scan from 200-2000; Source voltage: 5; Sheath gas: 60; Aux gas: 15; Cap temp: 350; Cap V: 35; Tube lens: 110. |
| UV Detection | UV 280 nm Detector: PDA (Thermo LXQ); Wavelength Step = 1 nm; Filter rise time = 1 sec; Sample rate = 5 Hz; Filter bandwidth = 1 nm |
| Retention time | Insulin product at 3.1 min; modified insulin product at 4.6 min |

LC-MS Analysis for the product resulting in the modification of insulin by the lysine donor substrate is shown in Table 12.2. The HTP assay mixtures prepared and formation of the modified insulin product compound detected by LC-MS-UV using the instrumental parameters and conditions are provided in Table 12.2. The mass of the product was used to determine the substrate and product peaks and the UV signal was used to quantify each species and compare to the positive control and calculate FIOP.

TABLE 12.2

| Analytical Method | |
|---|---|
| Instrument | Thermo LXQ |
| Column | Waters X-bridge C18 column: 50 × 3.0 mm, 5 um, with Phenomenex C18 guard Cartridge: 5 × 3.0 mm, 5 μm |
| Mobile Phase | Gradient (A: 0.2% formic acid in water; B: 0.2% formic acid in MeCN) |

| Time(min) | % A |
|---|---|
| 0.0 | 75 |
| 1.0 | 75 |
| 4.0 | 70 |
| 5.0 | 5.0 |
| 6.0 | 75 |
| 7.0 | 75 |

| | |
|---|---|
| Flow Rate | 0.7 mL/min |
| Run Time | 7 min |
| Column Temperature | 45° C. |
| Injection Volume | 10 μL |
| MS Detection | LXQ; divert flow from MS between 0-0.5 min. BP extracted ions for: insulin product (+6, +5, +4 species) = 969.3, 1162.8, 1453.0 mono-lysine modified insulin product (+6, +5, +4 species) = 990.8, 1188.6, 1485.3 di-lysine modified insulin product (+6, +5, +4 species) = 1012.3, 1214.4, 1517.5 tri-lysine modified insulin product (+6, +5, +4 species)= 1033.7, 1239.9, 1549.5 |
| MS Conditions | MS Polarity: Positive; Ionization: ESI; Mode: QI Scan from 200-2000; Source voltage: 5; Sheath gas: 60; Aux gas: 15; Cap temp: 350; Cap V: 35; Tube lens: 110 |
| Retention time | Insulin product at 3.0 min; mono-lysine modified insulin product at 2.7 mm; di-lysine modified insulin product at 2.5 min; tri-lysine modified insulin at 2.4 min |

While the invention has been described with reference to the specific embodiments, various changes can be made and equivalents can be substituted to adapt to a particular situation, material, composition of matter, process, process step or steps, thereby achieving benefits of the invention without departing from the scope of what is claimed.

For all purposes in the United States of America, each and every publication and patent document cited in this disclosure is incorporated herein by reference as if each such publication or document was specifically and individually indicated to be incorporated herein by reference. Citation of publications and patent documents is not intended as an indication that any such document is pertinent prior art, nor does it constitute an admission as to its contents or date.

SEQUENCE LISTING (756 sequences)

SEQ ID NO: 1 - DNA, 1164 bp, Artificial Sequence
  Streptomyces mobaraensis Transglutaminase with Pro Sequence and C-Terminus His Tag
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 2 - protein, 387 aa, Artificial Sequence
  Streptomyces mobaraensis Transglutaminase with Pro Sequence and C-Terminus His Tag
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 3 - DNA, 1011 bp, Artificial Sequence
  Streptomyces mobaraensis Mature Transglutaminase
atgtttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccataa

SEQ ID NO: 4 - protein, 336 aa, Artificial Sequence
  Streptomyces mobaraensis Mature Transglutaminase
MFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWP

SEQ ID NO: 5 - DNA, 1230 bp, Artificial Sequence
  Streptomyces mobaraensis Transglutaminase Pro Sequence and Bacillus Megaterium Signal Peptide
atgaatataaaacgttggcttttaacggcaacaacagttattctggctacatttggcgtcagtgcagtttcttctgttcatgcttctactagtatggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccataatga

SEQ ID NO: 6 - protein, 408 aa, Artificial Sequence
  Streptomyces mobaraensis Transglutaminase with Pro Sequence and Bacillus Megaterium Signal Peptide
MNIKRWLLTATTVILATFGVSAVSSVHASTSMDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWP

SEQ ID NO: 7 - DNA, 1230 bp, Artificial Sequence
  Varaint of Streptomyces mobaraensis Transglutaminase
atgaatataaaacgttggcttttaacggcaacaacagttattctggctacatttggcgtcagtgcagtttcttctgttcatgcttctactagtatggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccataatga

SEQ ID NO: 8 - protein, 408 aa, Artificial Sequence
  Varaint of Streptomyces mobaraensis Transglutaminase
MNIKRWLLTATTVILATFGVSAVSSVHASTSMDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVKQGWP

SEQ ID NO: 9 - DNA, 1230 bp, Artificial Sequence
  Varaint of Streptomyces mobaraensis Transglutaminase
atgaatataaaacgttggcttttaacggcaacaacagttattctggctacatttggcgtcagtgcagtttcttctgttcatgcttctactagtatggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccgtacagaccatctggaggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaacaaagcattagagaacgctcatgacgagtcagcatatcttgataaccttaagaaggagcttgcaaacggtaatgatgcacttcgtaacgaagacgcgcgttctcctttttattctgcacttagaaatacgccttctttcaaagaaagaaatggtggtaaccatgatccatctagaatgaaagcagttatctattctaagcatttttggtctggtcaggatcggtctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattcggattttgatcgtggtgcttacgttatcacttttattccaaaatcttggaatactgcaccagataaagtaaagcagggatggccataatga

SEQ ID NO: 10 - protein, 408 aa, Artificial Sequence
  Varaint of Streptomyces mobaraensis Transglutaminase
MNIKRWLLTATTVILATFGVSAVSSVHASTSMDNGAGEETKSYAETYRLTADDVANINALNESAPAASSAGPSFRAPDSDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNKALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWP

SEQ ID NO: 11 - DNA, 1230 bp, Artificial Sequence
  Varaint of Streptomyces mobaraensis Transglutaminase
atgaatataaaacgttggcttttaacggcaacaacagttattctggctacatttggcgtcagtgcagtttcttctgttcatgcttctactagtatggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccgtacagaccatctggaggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcgatgcacgtatacgaatcaaaatttcgtaactggtctgaaggatattctgattttgatcgtggtgcttacgttatcacttttattccaaaatcttggaatactgcaccagataaagtaaagcagggatggccataatga

SEQ ID NO: 12 - protein, 408 aa, Artificial Sequence
  Varaint of Streptomyces mobaraensis Transglutaminase
MNIKRWLLTATTVILATFGVSAVSSVHASTSMDNGAGEETKSYAETYRLTADDVANINALNESAPAASSAGPSFRAPDSDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWP

SEQ ID NO: 13 - DNA, 1230 bp, Artificial Sequence
  Varaint of Streptomyces mobaraensis Transglutaminase
atgaatataaaacgttggcttttaacggcaacaacagttattctggctacatttggcgtcagtgcagtttcttctgttcatgcttctactagtatggacaatggagctggtgaagaaacaaaatcttatgctgaaacatatagacttactgcagatgatgtagctaacatcaatgctttaaatgaatcagctcctgctgcatcttctgcaggaccttcttttagagctccagataaagatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccataatga

SEQ ID NO: 14 - protein, 408 aa, Artificial Sequence
  Varaint of Streptomyces mobaraensis Transglutaminase
MNIKRWLLTATTVILATFGVSAVSSVHASTSMDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWP

SEQ ID NO: 15 - DNA, 1230 bp, Artificial Sequence
  Varaint of Streptomyces mobaraensis Transglutaminase
atgaatataaaacgttggcttttaacggcaacaacagttattctggctacatttggcgtcagtgcagtttcttctgttcatgcttctactagtatggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccgtacagaccatctggaggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagacagatttaaaaacgaacttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacggtaatgatgcacttcgtaacgaagacgcgcgttctcctttttattctgcacttagaaatacgccttctttcaaagaaagaaatggtggtaaccatgatccatctagaatgaaagcagttatctattctaagcatttttggtctggtcaggatcagtctagctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcgatgcacgtatacgaatcaaaatttcgtaactggtctgaaggatattcggattttgatcgtggtgcttacgttatcacttttattccaaaatcttggaatactgcaccagataaagtaaagcagggatggccataatga

SEQ ID NO: 16 - protein, 408 aa, Artificial Sequence
  Varaint of Streptomyces mobaraensis Transglutaminase
MNIKRWLLTATTVILATFGVSAVSSVHASTSMDNGAGEETKSYAETYRLTADDVANINALNESAPAASSAGPSFRAPDSDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANGNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWP

SEQ ID NO: 17 - DNA, 1230 bp, Artificial Sequence
  Varaint of Streptomyces mobaraensis Transglutaminase
atgaatataaaacgttggcttttaacggcaacaacagttattctggctacatttggcgtcagtgcagtttcttctgttcatgcttctactagtatggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatctggtggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccataatga

SEQ ID NO: 18 - protein, 408 aa, Artificial Sequence
  Varaint of Streptomyces mobaraensis Transglutaminase
MNIKRWLLTATTVILATFGVSAVSSVHASTSMDNGAGEETKSYAETYRLTADDVANINALNESAPAASSAGPSFRAPDSDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWP

SEQ ID NO: 19 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaattatttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaatgcagggatggccaggccaaactggccaccatcaccatcaccattag

SEQ ID NO: 20 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGELFVNFDYGWFGAQTEADADKTVWTHGNHYHAPNGSLGAMHVYESKFRRWSHGYSDFDRGAYVITFIPKSWNTAPDKVMQGWPGQTGHHHHHH

SEQ ID NO: 21 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcacggatattctgattttgatcgtggtgcttacgttatcacttttattccaaaatcttggaatactgcaccagataaagtaatgcagggatggccaggccaaactggccaccatcaccatcaccattag

SEQ ID NO: 22 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSHGYSDFDRGAYVITFIPKSWNTAPDKVMQGWPGQTGHHHHHH

SEQ ID NO: 23 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 24 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSHGYSDFDRGAYVITFIPKSWNTAPDKVKQGWPGQTGHHHHHH

SEQ ID NO: 25 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaatgcagggatggccaggccaaactggccaccatcaccatcaccattag

SEQ ID NO: 26 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVMQGWPGQTGHHHHHH

SEQ ID NO: 27 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcacggatattctgattttgatcgtggtgcttacgttatcacttttattccaaaatcttggaatactgcaccagataaagtaatgcagggatggccaggccaaactggccaccatcaccatcaccattag

SEQ ID NO: 28 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSHGYSDFDRGAYVITFIPKSWNTAPDKVMQGWPGQTGHHHHHH

SEQ ID NO: 29 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttacggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 30 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 31 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagaacctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaattatttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 32 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGELFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 33 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 34 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 35 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaatgcagggatggccaggccaaactggccaccatcaccatcaccattag

SEQ ID NO: 36 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVMQGWPGQTGHHHHHH

SEQ ID NO: 37 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttacggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaattatttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcacggatattctgattttgatcgtggtgcttacgttatcacttttattccaaaatcttggaatactgcaccagataaagtaatgcagggatggccaggccaaactggccaccatcaccatcaccattag

SEQ ID NO: 38 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGELFVNFDYGWFGAQTEADADKTVWTHGNHYHAPNGSLGAMHVYESKFRNWSHGYSDFDRGAYVITFIPKSWNTAPDKVMQGWPGQTGHHHHHH

SEQ ID NO: 39 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaattatttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcacggatattctgattttgatcgtggtgcttacgttatcacttttattccaaaatcttggaatactgcaccagataaagtaatgcagggatggccaggccaaactggccaccatcaccatcaccattag

SEQ ID NO: 40 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGELFVNFDYGWFGAQTEADADKTVWTHGNHYHAPNGSLGAMHVYESKFRNWSHGYSDFDRGAYVITFIPKSWNTAPDKVMQGWPGQTGHHHHHH

SEQ ID NO: 41 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttacggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaattatttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcacggatattctgattttgatcgtggtgcttacgttatcacttttattccaaaatcttggaatactgcaccagataaagtaatgcagggatggccaggccaaactggccaccatcaccatcaccattag

SEQ ID NO: 42 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGELFVNFDYGWFGAQTEADADKTVWTHGNHYHAPNGSLGAMHVYESKFRNWSHGYSDFDRGAYVITFIPKSWNTAPDKVMQGWPGQTGHHHHHH

SEQ ID NO: 43 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 44 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSHGYSDFDRGAYVITFIPKSWNTAPDKVKQGWPGQTGHHHHHH

SEQ ID NO: 45 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcacggatattctgattttgatcgtggtgcttacgttatcacttttattccaaaatcttggaatactgcaccagataaagtaatgcagggatggccaggccaaactggccaccatcaccatcaccattag

SEQ ID NO: 46 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSHGYSDFDRGAYVITFIPKSWNTAPDKVMQGWPGQTGHHHHHH

SEQ ID NO: 47 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcacggatattctgattttgatcgtggtgcttacgttatcacttttattccaaaatcttggaatactgcaccagataaagtaatgcagggatggccaggccaaactggccaccatcaccatcaccattag

SEQ ID NO: 48 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSHGYSDFDRGAYVITFIPKSWNTAPDKVMQGWPGQTGHHHHHH

SEQ ID NO: 49 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaattatttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 50 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGELFVNFDYGWFGAQTEADADKTVWTHGNHYHAPNGSLGAMHVYESKFRNWSHGYSDFDRGAYVITFIPKSWNTAPDKVKQGWPGQTGHHHHHH

SEQ ID NO: 51 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 52 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 53 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaattatttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 54 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGELFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 55 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 56 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSHGYSDFDRGAYVITFIPKSWNTAPDKVKQGWPGQTGHHHHHH

SEQ ID NO: 57 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaattatttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcacggatattctgattttgatcgtggtgcttacgttatcacttttattccaaaatcttggaatactgcaccagataaagtaatgcagggatggccaggccaaactggccaccatcaccatcaccattag

SEQ ID NO: 58 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGELFVNFDYGWFGAQTEADADKTVWTHGNHYHAPNGSLGAMHVYESKFRNWSHGYSDFDRGAYVITFIPKSWNTAPDKVMQGWPGQTGHHHHHH

SEQ ID NO: 59 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttacggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 60 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSHGYSDFDRGAYVITFIPKSWNTAPDKVKQGWPGQTGHHHHHH

SEQ ID NO: 61 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttacggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaattatttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 62 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGELFVNFDYGWFGAQTEADADKTVWTHGNHYHAPNGSLGAMHVYESKFRNWSHGYSDFDRGAYVITFIPKSWNTAPDKVKQGWPGQTGHHHHHH

SEQ ID NO: 63 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 64 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 65 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 66 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSHGYSDFDRGAYVITFIPKSWNTAPDKVKQGWPGQTGHHHHHH

SEQ ID NO: 67 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacgagccatcttacggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacagagcattagagaacgctcatgacgagtcagcatatcttgataaccttaagaaggagcttgcaaacgttaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagttcagggatggccaggccaaactggccaccatcaccatcaccattag

SEQ ID NO: 68 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 69 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttacggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 70 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 71 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 72 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 73 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaattatttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 74 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGELFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 75 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 76 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSHGYSDFDRGAYVITFIPKSWNTAPDKVKQGWPGQTGHHHHHH

SEQ ID NO: 77 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacgagccatctggaggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacagagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtggtgcttacgttatcacttttattccaaaatcttggaatactgcaccagataaagtagttcagggatggccaggccaaactggccaccatcaccatcaccattag

SEQ ID NO: 78 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWEEGYSDFDRGAYVITFIPKSWNTAPDKVVQGWPGQTGHHHHHH

SEQ ID NO: 79 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaattatttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgaaggatattctgattttgatcgtggtgcttacgttatcacttttattccaaaatcttggaatactgcaccagataaagtaatgcagggatggccaggccaaactggccaccatcaccatcaccattag

SEQ ID NO: 80 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGELFVNFDYGWFGAQTEADADKTVWTHGNHYHAPNGSLGAMHVYESKFRRWSEGYSDFDRGAYVITFIPKSWNTAPDKVMQGWPGQTGHHHHHH

SEQ ID NO: 81 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 82 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 83 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacagagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 84 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 85 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagagcgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagagcgcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgtagctcttcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 86 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRASYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSKDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 87 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 88 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNYDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 89 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagagcgtcttatggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagggcgcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgtagctcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 90 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRASYGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDEGAYLDNLKKELANGNDALRNEDARSNFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 91 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 92 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 93 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaactatgatccatctagaatgaaagcagttatctattctaagcatttttggtctggtcaggatcgtagctcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 94 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSNFYSALRNTPSFKERNGGNYDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 95 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 96 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSEGYSDFDRGAYVITFIPKSWNTAPDKVKQGWPGQTGHHHHHH

SEQ ID NO: 97 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacgagccatctggaggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacagagcattagagaacgctcatgacgagtcagcatatcttgataaccttaagaaggagcttgcaaacgttaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtggtgcttacgttatcacttttattccaaaatcttggaatactgcaccagataaagtaaagcagggatggccaggccaaactggccaccatcaccatcaccattag

SEQ ID NO: 98 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWEEGYSDFDRGAYVITFIPKSWNTAPDKVKQGWPGQTGHHHHHH

SEQ ID NO: 99 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagggcgcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgtagctcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 100 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDEGAYLDNLKKELANGNDALRNEDARSNFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 101 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgtagctcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 102 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 103 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgaaggatattctgattttgatcgtggtgcttacgttatcacttttattccaaaatcttggaatactgcaccagataaagtaatgcagggatggccaggccaaactggccaccatcaccatcaccattag

SEQ ID NO: 104 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRRWSEGYSDFDRGAYVITFIPKSWNTAPDKVMQGWPGQTGHHHHHH

SEQ ID NO: 105 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagttcagggatggccaggccaaactggccaccatcaccatcaccattag

SEQ ID NO: 106 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 107 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagagcgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgtagctcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 108 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRASYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 109 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagagcgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagaattgctaaggaatctttcgatgaagaaaaaggatttcaaagagcacgtgatgtagcatctgtaatgaaccgtgcattagagaacgctcatgacgagagcgcatatctcgataaccttaagaaggagcttgcaaacggtaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgtagctcttcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 110 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRASYGRAETVVNNYIRKWQQVYSHRDGRKQQMTEEQREWLSYGCVGVTWVNSGQYPTNRLAFASFDEDRFKNELKNGRPRSGETRAEFEGRIAKESFDEEKGFQRARDVASVMNRALENAHDESAYLDNLKKELANGNDALRNEDARSPFYSALRNTPSFKERNGGNYDPSRMKAVIYSKHFWSGQDRSSSADKRKYGDPDAFRPAPGTGLVDMSKDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 111 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgatgtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 112 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRARDVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSKDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 113 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgatgtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgtagctcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 114 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRARDVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 115 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgtcgctcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 116 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRRSSADKRKYGDPDAFRPAPGTGLVDMSRDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 117 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgatgtagcatctgtaatgaaccgtgcattagagaacgctcatgacgagagcgcatatcttgataaccttaagaaggagcttgcaaacggtaatgatgcacttcgtaacgaagacgcacgttctaacttttattctgcacttagaaatacgccttctttcaaagaaagaaatggtggtaactatgatccatctagaatgaaagcagttatctattctaagcatttttggtctggtcaggatcgtagctcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 118 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRARDVASVMNRALENAHDESAYLDNLKKELANGNDALRNEDARSNFYSALRNTPSFKERNGGNYDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 119 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacgagccatctggaggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtggtgcttacgttatcacttttattccaaaatcttggaatactgcaccagataaagtagttcagggatggccaggccaaactggccaccatcaccatcaccattag

SEQ ID NO: 120 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWEEGYSDFDRGAYVITFIPKSWNTAPDKVVQGWPGQTGHHHHHH

SEQ ID NO: 121 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagagcgcatatcttgataaccttaagaaggagcttgcaaacggtaatgatgcacttcgtaacgaagacgcacgttctcacttttattctgcacttagaaatacgccttctttcaaagaaagaaatggtggtaaccatgatccatctagaatgaaagcagttatctattctaagcatttttggtctggtcaggatcgtcgctcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 122 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSHFYSALRNTPSFKERNGGNHDPSRMKAVIYSKHFWSGQDRRSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 123 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgtcgctcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 124 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRRSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 125 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaattatttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgaaggatattctgattttgatcgtggtgcttacgttatcacttttattccaaaatcttggaatactgcaccagataaagtaatgcagggatggccaggccaaactggccaccatcaccatcaccattag

SEQ ID NO: 126 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGELFVNFDYGWFGAQTEADADKTVWTHGNHYHAPNGSLGAMHVYESKFRRWSEGYSDFDRGAYVITFIPKSWNTAPDKVMQGWPGQTGHHHHHH

SEQ ID NO: 127 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 128 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 129 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagagcgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagagcgcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgtagctcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 130 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRASYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 131 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 132 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 133 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagggcgcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 134 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDEGAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 135 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 136 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 137 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgatgtagcatctgtaatgaaccgtgcattagagaacgctcatgacgagggcgcatatcttgataaccttaagaaggagcttgcaaacggtaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgtagctcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 138 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRARDVASVMNRALENAHDEGAYLDNLKKELANGNDALRNEDARSPFYSALRNTPSFKERNGGNYDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 139 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacgagccatctggaggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgttaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 140 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 141 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgatgtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgtagctcttcagctgataaacgtaagtacggtgaccctgatgcatttagaccagcacctggaacaggtcttgttgatatgtcaaaagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 142 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRARDVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSKDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 143 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgtcgctcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 144 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRRSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 145 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgatgtagcatctgtaatgaaccgtgcattagagaacgctcatgacgagagcgcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgtcgctcttcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 146 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRARDVASVMNRALENAHDESAYLDNLKKELANGNDALRNEDARSNFYSALRNTPSFKERNGGNHDPSRMKAVIYSKHFWSGQDRRSSADKRKYGDPDAFRPAPGTGLVDMSKDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 147 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagaattgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgtcgctcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 148 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRIAKESFDEEKGFQRAREVASVMNRALENAHDESAYLDNLKKELANGNDALRNEDARSNFYSALRNTPSFKERNGGNHDPSRMKAVIYSKHFWSGQDRRSSADKRKYGDPDAFRPAPGTGLVDMSRDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 149 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 150 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 151 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagagcgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagaattgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 152 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRASYGRAETVVNNYIRKWQQVYSHRDGRKQQMTEEQREWLSYGCVGVTWVNSGQYPTNRLAFASFDEDRFKNELKNGRPRSGETRAEFEGRIAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 153 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagaattgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 154 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRIAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 155 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgtcgctcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 156 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNYDPSRMKAVIYSKHFWSGQDRRSSADKRKYGDPDAFRPAPGTGLVDMSRDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 157 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgtcgctcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 158 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRRSSADKRKYGDPDAFRPAPGTGLVDMSRDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 159 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagagcgcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 160 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 161 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagaattgctaaggaatctttcgatgaagaaaaaggatttcaaagagcacgtgaagtagcatctgtaatgaaccgtgcattagagaacgctcatgacgagggcgcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgtcgctcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 162 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRIAKESFDEEKGFQRAREVASVMNRALENAHDEGAYLDNLKKELANGNDALRNEDARSNFYSALRNTPSFKERNGGNHDPSRMKAVIYSKHFWSGQDRRSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 163 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagagcgcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgtagctcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 164 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 165 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagagcgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgtcgctcttcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 166 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRASYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRRSSADKRKYGDPDAFRPAPGTGLVDMSKDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 167 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagagcgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 168 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRASYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 169 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatctctcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaattatttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 170 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSLGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGELFVNFDYGWFGAQTEADADKTVWTHGNHYHAPNGSLGAMHVYESKFRRWSEGYSDFDRGAYVITFIPKSWNTAPDKVKQGWPGQTGHHHHHH

SEQ ID NO: 171 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgttaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 172 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 173 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagggcgcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgtcgctcttcagctgataaacgtaagtacggtgaccctgatgcatttagaccagcacctggaacaggtcttgttgatatgtcaaaagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 174 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDEGAYLDNLKKELANGNDALRNEDARSPFYSALRNTPSFKERNGGNHDPSRMKAVIYSKHFWSGQDRRSSADKRKYGDPDAFRPAPGTGLVDMSKDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 175 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaattatttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 176 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGELFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 177 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacgagccatcttacggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacagagcattagagaacgctcatgacgagtcagcatatcttgataaccttaagaaggagcttgcaaacgttaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtggtgcttacgttatcacttttattccaaaatcttggaatactgcaccagataaagtaaagcagggatggccaggccaaactggccaccatcaccatcaccattag

SEQ ID NO: 178 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWEEGYSDFDRGAYVITFIPKSWNTAPDKVKQGWPGQTGHHHHHH

SEQ ID NO: 179 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagaattgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 180 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRIAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 181 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacagagcattagagaacgctcatgacgagtcagcatatcttgataaccttaagaaggagcttgcaaacgttaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtggtgcttacgttatcacttttattccaaaatcttggaatactgcaccagataaagtaaagcagggatggccaggccaaactggccaccatcaccatcaccattag

SEQ ID NO: 182 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWEEGYSDFDRGAYVITFIPKSWNTAPDKVKQGWPGQTGHHHHHH

SEQ ID NO: 183 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttaccgtccatctaacggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgttaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagttcagggatggccaggccaaactggccaccatcaccatcaccattag

SEQ ID NO: 184 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSNGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 185 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttaccgtccatctggaggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacagagcattagagaacgctcatgacgagtcagcatatcttgataaccttaagaaggagcttgcaaacgttaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtggtgcttacgttatcacttttattccaaaatcttggaatactgcaccagataaagtagttcagggatggccaggccaaactggccaccatcaccatcaccattag

SEQ ID NO: 186 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWEEGYSDFDRGAYVITFIPKSWNTAPDKVVQGWPGQTGHHHHHH

SEQ ID NO: 187 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacgagccatctggaggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacagagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 188 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 189 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 190 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 191 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgatgtagcatctgtaatgaaccgtgcattagagaacgctcatgacgagagcgcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgtcgctcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcaggatattctgattttgatcgtggtgcttacgttatcacttttattccaaaatcttggaatactgcaccagataaagtaaagcagggatggccaggccaaactggccaccatcaccatcaccattag

SEQ ID NO: 192 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRARDVASVMNRALENAHDESAYLDNLKKELANGNDALRNEDARSNFYSALRNTPSFKERNGGNHDPSRMKAVIYSKHFWSGQDRRSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 193 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttaccgtccatcttacggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtggtgcttacgttatcacttttattccaaaatcttggaatactgcaccagataaagtaaagcagggatggccaggccaaactggccaccatcaccatcaccattag

SEQ ID NO: 194 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWEEGYSDFDRGAYVITFIPKSWNTAPDKVKQGWPGQTGHHHHHH

SEQ ID NO: 195 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacgagccatctggaggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgttaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtggtgcttacgttatcacttttattccaaaatcttggaatactgcaccagataaagtaaagcagggatggccaggccaaactggccaccatcaccatcaccattag

SEQ ID NO: 196 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWEEGYSDFDRGAYVITFIPKSWNTAPDKVKQGWPGQTGHHHHHH

SEQ ID NO: 197 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacgagccatctggaggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtggtgcttacgttatcacttttattccaaaatcttggaatactgcaccagataaagtaaagcagggatggccaggccaaactggccaccatcaccatcaccattag

SEQ ID NO: 198 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWEEGYSDFDRGAYVITFIPKSWNTAPDKVKQGWPGQTGHHHHHH

SEQ ID NO: 199 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacgagccatctaacggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacagagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 200 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSNGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 201 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaatgcagggatggccaggccaaactggccaccatcaccatcaccattag

SEQ ID NO: 202 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVMQGWPGQTGHHHHHH

SEQ ID NO: 203 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacagagcattagagaacgctcatgacgagtcagcatatcttgataaccttaagaaggagcttgcaaacgttaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 204 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 205 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtggtgcttacgttatcacttttattccaaaatcttggaatactgcaccagataaagtaaagcagggatggccaggccaaactggccaccatcaccatcaccattag

SEQ ID NO: 206 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWEEGYSDFDRGAYVITFIPKSWNTAPDKVKQGWPGQTGHHHHHH

SEQ ID NO: 207 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacgagccatcttacggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacagagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtggtgcttacgttatcacttttattccaaaatcttggaatactgcaccagataaagtaaagcagggatggccaggccaaactggccaccatcaccatcaccattag

SEQ ID NO: 208 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWEEGYSDFDRGAYVITFIPKSWNTAPDKVKQGWPGQTGHHHHHH

SEQ ID NO: 209 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 210 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 211 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttaccgtccatcttacggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacagagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtggtgcttacgttatcacttttattccaaaatcttggaatactgcaccagataaagtaaagcagggatggccaggccaaactggccaccatcaccatcaccattag

SEQ ID NO: 212 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWEEGYSDFDRGAYVITFIPKSWNTAPDKVKQGWPGQTGHHHHHH

SEQ ID NO: 213 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacgagccatctaacggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacagagcattagagaacgctcatgacgagtcagcatatcttgataaccttaagaaggagcttgcaaacgttaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtcatgcttacgttatcacttttattccaaaatcttggaatactgcaccagataaagtacttcagggatggccaggccaaactggccaccatcaccatcaccattag

SEQ ID NO: 214 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSNGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWEEGYSDFDRHAYVITFIPKSWNTAPDKVLQGWPGQTGHHHHHH

SEQ ID NO: 215 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 216 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 217 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagagcgcatatcttgataaccttaagaaggagcttgcaaacggtaatgatgcacttcgtaacgaagacgcacgttctaacttttattctgcacttagaaatacgccttctttcaaagaaagaaatggtggtaactatgatccatctagaatgaaagcagttatctattctaagcatttttggtctggtcaggatcgtagctcttcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 218 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNYDPSRMKAVIYSKHFWSGQDRSSSADKRKYGDPDAFRPAPGTGLVDMSKDRNIPRSPTSPGEGWVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 219 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 220 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 221 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaattatttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 222 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDQSSSADKRKYGDPDAFRPAPGTGLVDMSRDRNIPRSPTSPGELFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 223 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacgagccatcttacggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacagagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 224 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 225 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaattatttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 226 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGELFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 227 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagaattgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgtcgctcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 228 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRFKNELKNGRPRSGETRAEFEGRIAKESFDEEKGFQRAREVASVMNRALENAHDESAYLDNLKKELANGNDALRNEDARSPFYSALRNTPSFKERNGGNHDPSRMKAVIYSKHFWSGQDRRSSADKRKYGDPDAFRPAPGTGLVDMSRDRNIPRSPTSPGEGWVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 229 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtggtgcttacgttatcacttttattccaaaatcttggaatactgcaccagataaagtaaagcagggatggccaggccaaactggccaccatcaccatcaccattag

SEQ ID NO: 230 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWEEGYSDFDRGAYVITFIPKSWNTAPDKVKQGWPGQTGHHHHHH

SEQ ID NO: 231 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacagagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 232 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 233 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagagcgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgtagctcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 234 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRASYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNYDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 235 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacagaccatcttacggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgttaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtggtgcttacgttatcacttttattccaaaatcttggaatactgcaccagataaagtaaagcagggatggccaggccaaactggccaccatcaccatcaccattag

SEQ ID NO: 236 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWEEGYSDFDRGAYVITFIPKSWNTAPDKVKQGWPGQTGHHHHHH

SEQ ID NO: 237 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 238 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANGNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 239 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatctgacggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttaaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 240 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSDGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFKRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 241 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacagagcattagagaacgctcatgacgagtcagcatatcttgataaccttaagaaggagcttgcaaacgttaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtggtgcttacgttatcacttttattccaaaatcttggaatactgcaccagataaagtaaagcagggatggccaggccaaactggccaccatcaccatcaccattag

SEQ ID NO: 242 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWEEGYSDFDRGAYVITFIPKSWNTAPDKVKQGWPGQTGHHHHHH

SEQ ID NO: 243 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcggtcttcttcagctgataaacgtaagtacggtgaccctgatgcatttagaccagcacctggaacaggtcttgttgatatgtcaagagaccgtaacatcccaagatcacctacgtctccaggtgaattatttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 244 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGELFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 245 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagagcgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgtagctcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 246 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRASYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSPFYSALRNTPSFKERNGGNYDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 247 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacagagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtggtgcttacgttatcacttttattccaaaatcttggaatactgcaccagataaagtacttcagggatggccaggccaaactggccaccatcaccatcaccattag

SEQ ID NO: 248 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWEEGYSDFDRGAYVITFIPKSWNTAPDKVLQGWPGQTGHHHHHH

SEQ ID NO: 249 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacagaccatctaacggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgttaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtggtgcttacgttatcacttttattccaaaatcttggaatactgcaccagataaagtaaagcagggatggccaggccaaactggccaccatcaccatcaccattag

SEQ ID NO: 250 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSNGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWEEGYSDFDRGAYVITFIPKSWNTAPDKVKQGWPGQTGHHHHHH

SEQ ID NO: 251 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccgtcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagagcgcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccattag

SEQ ID NO: 252 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 253 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgttgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgttaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactgggaggaaggatattctgattttgatcgtggtgcttacgttatcacttttattccaaaatcttggaatactgcaccagataaagtaaagcagggatggccaggccaaactggccaccatcaccatcaccattag

SEQ ID NO: 254 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWEEGYSDFDRGAYVITFIPKSWNTAPDKVKQGWPGQTGHHHHHH

SEQ ID NO: 255 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 256 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 257 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgcaagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 258 - protein, 387 aa, Artificial Sequence
  Varaint of Streptomyces mobaraensis Transglutaminase
MDNGAGEETKSYAETYRLTADDVANINALNESAPAASSAGPSFRAPDKDARVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 259 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctcatggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 260 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSHGAMHVYESKFRRWSHGYSDFDRGAYVITFIPKSWNTAPDKVKQGWPGQTGHHHHHH

SEQ ID NO: 261 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctccaggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 262 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSPGAMHVYESKFRRWSHGYSDFDRGAYVITFIPKSWNTAPDKVKQGWPGQTGHHHHHH

SEQ ID NO: 263 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcaaagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 264 - protein, 387 aa, Artificial Sequence
  Varaint of Streptomyces mobaraensis Transglutaminase
MDNGAGEETKSYAETYRLTADDVANINALNESAPAASSAGPSFRAPDKDQRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 265 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattcttgggatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 266 - protein, 387 aa, Artificial Sequence
  Varaint of Streptomyces mobaraensis Transglutaminase
MDNGAGEETKSYAETYRLTADDVANINALNESAPAASSAGPSFRAPDSWDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 267 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctgttggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 268 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSVGAMHVYESKFRRWSHGYSDFDRGAYVITFIPKSWNTAPDKVKQGWPGQTGHHHHHH

SEQ ID NO: 269 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggattttagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 270 - protein, 387 aa, Artificial Sequence
  Varaint of Streptomyces mobaraensis Transglutaminase
MDNGAGEETKSYAETYRLTADDVANINALNESAPAASSAGPSFRAPDKDFRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 271 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgaggccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 272 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTRPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 273 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcaccttgttctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 274 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPCSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 275 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttatttaggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 276 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGYLGAMHVYESKFRRWSHGYSDFDRGAYVITFIPKSWNTAPDKVKQGWPGQTGHHHHHH

SEQ ID NO: 277 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctaggggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 278 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSRGAMHVYESKFRRWSHGYSDFDRGAYVITFIPKSWNTAPDKVKQGWPGQTGHHHHHH

SEQ ID NO: 279 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggtcatttaggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 280 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGHLGAMHVYESKFRRWSHGYSDFDRGAYVITFIPKSWNTAPDKVKQGWPGQTGHHHHHH

SEQ ID NO: 281 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataagtatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 282 - protein, 387 aa, Artificial Sequence
  Varaint of Streptomyces mobaraensis Transglutaminase
MDNGAGEETKSYAETYRLTADDVANINALNESAPAASSAGPSFRAPDKYDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 283 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattcttgggctagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttcggtcggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 284 - protein, 387 aa, Artificial Sequence
  Varaint of Streptomyces mobaraensis Transglutaminase
MDNGAGEETKSYAETYRLTADDVANINALNESAPAASSAGPSFRAPDSWARVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSVGAMHVYESKFRRWSHGYSDFDRGAYVITFIPKSWNTAPDKVKQGWPGQTGHHHHHH

SEQ ID NO: 285 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattcttacgctagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcaccttgccgcccaggtgaaggttttgtaaactttgattacggatggtttggagctcagacagaagctgatgcagataagacagtatggactcatggaaatcattatcacgctcctaacggttcggtcggtgcaatgcacgtatacgaatcaaaatttcgtaggtggtctcacggatatagcgattttgatcgtggtgcttacgttatcacttttattccaaaatcttggaatactgcaccagataaagtaaagcagggatggccaggccaaactggccaccatcaccatcaccattag

SEQ ID NO: 286 - protein, 387 aa, Artificial Sequence
  Varaint of Streptomyces mobaraensis Transglutaminase
MDNGAGEETKSYAETYRLTADDVANINALNESAPAASSAGPSFRAPDSYARVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPCRPGEGFVNFDYGWFGAQTEADADKTVWTHGNHYHAPNGSVGAMHVYESKFRRWSHGYSDFDRGAYVITFIPKSWNTAPDKVKQGWPGQTGHHHHHH

SEQ ID NO: 287 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtagatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtaatgcagggatggcca

SEQ ID NO: 288 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNYDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 289 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattcttgggctagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgcgcccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 290 - protein, 387 aa, Artificial Sequence
  Varaint of Streptomyces mobaraensis Transglutaminase
MDNGAGEETKSYAETYRLTADDVANINALNESAPAASSAGPSFRAPDSWARVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTRPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 291 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagatgtagatcgtagagtaactcctcctgcagagcctcttgatagaatgccagatccttaccgaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtaatgcagggatggcca

SEQ ID NO: 292 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNYDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 293 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaatgcagggatggcca

SEQ ID NO: 294 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVMQGWPGQTGHHHHHH

SEQ ID NO: 295 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattcttggcgaagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgagcccaggtgaaggttttgtaaactttgattacggatggtttggagctcagacagaagctgatgcagataagacagtatggactcatggaaatcattatcacgctcctaacggttatgtcggtgcaatgcacgtatacgaatcaaaatttcgtaggtggtctcacggatatagcgattttgatcgtggtgcttacgttatcacttttattccaaaatcttggaatactgcaccagataaagtaaagcagggatggccaggccaaactggccaccatcaccatcaccattag

SEQ ID NO: 296 - protein, 387 aa, Artificial Sequence
  Varaint of Streptomyces mobaraensis Transglutaminase
MDNGAGEETKSYAETYRLTADDVANINALNESAPAASSAGPSFRAPDSWRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGYVGAMHVYESKFRRWSHGYSDFDRGAYVITFIPKSWNTAPDKVKQGWPGQTGHHHHHH

SEQ ID NO: 297 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagataaggatcgtagagtaactcctcctgcagagcctcttgatagaatgccagatccttacgagccatctggaggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcatttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtactgcagggatggcca

SEQ ID NO: 298 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSGGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSHFYSALRNTPSFKERNGGNYDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRRWSAGYSDFDRGAYVITFIPKSWNTAPDKVLQGWPGQTGHHHHHH

SEQ ID NO: 299 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattcttgggctagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgagcccaggtgaaggttttgtaaactttgattacggatggtttggagctcagacagaagctgatgcagataagacagtatggactcatggaaatcattatcacgctcctaacggttcgcttggtgcaatgcacgtatacgaatcaaaatttcgtaggtggtctcacggatatcgcgattttgatcgtggtgcttacgttatcacttttattccaaaatcttggaatactgcaccagataaagtaaagcagggatggccaggccaaactggccaccatcaccatcaccattag

SEQ ID NO: 300 - protein, 387 aa, Artificial Sequence
  Varaint of Streptomyces mobaraensis Transglutaminase
MDNGAGEETKSYAETYRLTADDVANINALNESAPAASSAGPSFRAPDSWARVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYRDFDRGAYVITFIPKSWNTAPDKVKQGWPGQTGHHHHHH

SEQ ID NO: 301 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtaaagcagggatggcca

SEQ ID NO: 302 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRRWSAGYSDFDRGAYVITFIPKSWNTAPDKVKQGWPGQTGHHHHHH

SEQ ID NO: 303 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagataaggatcgtagagtaactcctcctgcagagcctcttgatagaatgccagatccttacgagccatcttatggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcatttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtagtgcagggatggcca

SEQ ID NO: 304 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSYGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSHFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVVQGWPGQTGHHHHHH

SEQ ID NO: 305 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacgagccatctggaggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcatttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtaatgcagggatggcca

SEQ ID NO: 306 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSGGRATTVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANVNDALRNEDARSHFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 307 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagataaggatcgtagagtaactcctcctgcagagcctcttgatagaatgccagatccttacgagccatcttatggacgtgctgagacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcatttttattctgcacttagaaatacgccttctttcaaagaaagaaatggtggtaactatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtagtgcagggatggcca

SEQ ID NO: 308 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSHFYSALRNTPSFKERNGGNYDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRRWSAGYSDFDRGAYVITFIPKSWNTAPDKVVQGWPGQTGHHHHHH

SEQ ID NO: 309 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagatgtagatcgtagagtaactcctcctgcagagcctcttgatagaatgccagatccttacgaaccatcttatggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtaatgcagggatggcca

SEQ ID NO: 310 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYEPSYGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNYDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 311 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgcgcccaggtgaaggttttgtaaactttgattacggatggtttggagctcagacagaagctgatgcagataagacagtatggactcatggaaatcattatcacgctcctaacggttatcctggtgcaatgcacgtatacgaatcaaaatttcgtaggtggtctcacggatatagcgattttgatcgtggtgcttacgttatcacttttattccaaaatcttggaatactgcaccagataaagtaaagcagggatggccaggccaaactggccaccatcaccatcaccattag

SEQ ID NO: 312 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTRPGEGFVNFDYGWFGAQTEADADKTVWTHGNHYHAPNGYPGAMHVYESKFRRWSHGYSDFDRGAYVITFIPKSWNTAPDKVKQGWPGQTGHHHHHH

SEQ ID NO: 313 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagataaggatcgtagagtaactcctcctgcagagcctcttgatagaatgccagatccttacgagccatctggaggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcatttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaatgcagggatggcca

SEQ ID NO: 314 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSGGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSHFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVMQGWPGQTGHHHHHH

SEQ ID NO: 315 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattcgggtgctagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgcgcccaggtgaaggttttgtaaactttgattacggatggtttggagctcagacagaagctgatgcagataagacagtatggactcatggaaatcattatcacgctcctaacggttcgcctggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 316 - protein, 387 aa, Artificial Sequence
  Varaint of Streptomyces mobaraensis Transglutaminase
MDNGAGEETKSYAETYRLTADDVANINALNESAPAASSAGPSFRAPDSGARVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTRPGEGFVNFDYGWFGAQTEADADKTVWTHGNHYHAPNGSPGAMHVYESKFRRWSHGYSDFDRGAYVITFIPKSWNTAPDKVKQGWPGQTGHHHHHH

SEQ ID NO: 317 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagatgtagatcgtagagtaactcctcctgcagagcctcttgatagaatgccagatccttacgagccatcttatggacgtgctgagacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtaatgcagggatggcca

SEQ ID NO: 318 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 319 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacgagccatcttatggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcatttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtactgcagggatggcca

SEQ ID NO: 320 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSYGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSHFYSALRNTPSFKERNGGNHDPSRMKAVIYSKHFWSGQDRSGSADKRKYGDPDAFRPAPGTGLVDMSRDRNIPRSPTSPGEGWVNFDYGWFGAQTEADADKTVWTHGNHYHAPNGSLGAMHVYESKFRRWSAGYSDFDRGAYVITFIPKSWNTAPDKVLQGWPGQTGHHHHHH

SEQ ID NO: 321 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacgagccatctggaggacgtgctgagacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtaatgcagggatggcca

SEQ ID NO: 322 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSGGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 323 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacgagccatctggaggacgtgctgagacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcatttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtactgcagggatggcca

SEQ ID NO: 324 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSHFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVLQGWPGQTGHHHHHH

SEQ ID NO: 325 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagatgtagatcgtagagtaactcctcctgcagagcctcttgatagaatgccagatccttacgagccatctggaggacgtgctgagacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtaaagcagggatggcca

SEQ ID NO: 326 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNYDPSRMKAVIYSKHFWSGQDRSGSADKRKYGDPDAFRPAPGTGLVDMSKDRNIPRSPTSPGEGWVNFDYGWFGAQTEADADKTVWTHGNHYHAPNGSLGAMHVYESKFRRWSAGYSDFDRGAYVITFIPKSWNTAPDKVKQGWPGQTGHHHHHH

SEQ ID NO: 327 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtagatcgtagagtaactcctcctgcagagcctcttgatagaatgccagatccttacgaaccatcttatggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtaaagcagggatggcca

SEQ ID NO: 328 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYEPSYGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVKQGWPGQTGHHHHHH

SEQ ID NO: 329 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcagcgctttaaatgaatcagctcctgctgcatcttctgcaggaccttcttttagagctccagatgtagatcgtagagtaactcctcctgcagagcctcttgatagaatgccagatccttacgagccatctggaggacgtgctgagacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtactgcagggatggcca

SEQ ID NO: 330 - protein, 387 aa, Artificial Sequence
  Varaint of Streptomyces mobaraensis Transglutaminase
MDNGAGEETKSYAETYRLTADDVANISALNESAPAASSAGPSFRAPDVDRRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVLQGWPGQTGHHHHHH

SEQ ID NO: 331 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaatgggctagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttcggtcggtgcaatgcacgtatacgaatcaaaatttcgtaggtggtctcacggatatagcgattttgatcgtggtgcttacgttatcacttttattccaaaatcttggaatactgcaccagataaagtaaagcagggatggccaggccaaactggccaccatcaccatcacccttag

SEQ ID NO: 332 - protein, 393 aa, Artificial Sequence
  Varaint of Streptomyces mobaraensis Transglutaminase
MDNGAGEETKSYAETYRLTADDVANINALNESAPAASSAGPSFRAPDKWARVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSVGAMHVYESKFRRWSHGYSDFDRGAYVITFIPKSWNTAPDKVKQGWPGQTGHHHHHPHHHHHH

SEQ ID NO: 333 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacgagccatctggaggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcatttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtagtgcagggatggcca

SEQ ID NO: 334 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSGGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSHFYSALRNTPSFKERNGGNYDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVVQGWPGQTGHHHHHH

SEQ ID NO: 335 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcagcgctttaaatgaatcagctcctgctgcatcttctgcaggaccttcttttagagctccagatgtagatcgtagagtaactcctcctgcagagcctcttgatagaatgccagatccttacgagccatctggaggacgtgctgagacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcatttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaaaagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtagtgcagggatggcca

SEQ ID NO: 336 - protein, 387 aa, Artificial Sequence
  Varaint of Streptomyces mobaraensis Transglutaminase
MDNGAGEETKSYAETYRLTADDVANISALNESAPAASSAGPSFRAPDVDRRVTPPAEPLDRMPDPYEPSGGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANVNDALRNEDARSHFYSALRNTPSFKERNGGNHDPSRMKAVIYSKHFWSGQDRSGSADKRKYGDPDAFRPAPGTGLVDMSKDRNIPRSPTSPGEGFVNFDYGWFGAQTEADADKTVWTHGNHYHAPNGSLGAMHVYESKFRRWSAGYSDFDRGAYVITFIPKSWNTAPDKVVQGWPGQTGHHHHHH

SEQ ID NO: 337 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagataaggatcgtagagtaactcctcctgcagagcctcttgatagaatgccagatccttacgagccatcttatggacgtgctgagacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcatttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtagtgcagggatggcca

SEQ ID NO: 338 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANVNDALRNEDARSHFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVVQGWPGQTGHHHHHH

SEQ ID NO: 339 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagataaggatcgtagagtaactcctcctgcagagcctcttgatagaatgccagatccttaccggccatctggaggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcatttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtagtgcagggatggcca

SEQ ID NO: 340 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSGGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSHFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVVQGWPGQTGHHHHHH

SEQ ID NO: 341 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagataaggatcgtagagtaactcctcctgcagagcctcttgatagaatgccagatccttacgagccatctggaggacgtgctgagacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcatttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 342 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSHFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 343 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagatgtagatcgtagagtaactcctcctgcagagcctcttgatagaatgccagatccttacgagccatctggaggacgtgctgagacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcatttttattctgcacttagaaatacgccttctttcaaagaaagaaatggtggtaactatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtaaagcagggatggcca

SEQ ID NO: 344 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSHFYSALRNTPSFKERNGGNYDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVKQGWPGQTGHHHHHH

SEQ ID NO: 345 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagatgtagatcgtagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtaatgcagggatggcca

SEQ ID NO: 346 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 347 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcagcgctttaaatgaatcagctcctgctgcatcttctgcaggaccttcttttagagctccagatgtagatcgtagagtaactcctcctgcagagcctcttgatagaatgccagatccttacgaaccatcttatggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtaatgcagggatggcca

SEQ ID NO: 348 - protein, 387 aa, Artificial Sequence
  Varaint of Streptomyces mobaraensis Transglutaminase
MDNGAGEETKSYAETYRLTADDVANISALNESAPAASSAGPSFRAPDVDRRVTPPAEPLDRMPDPYEPSYGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 349 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagataaggatcgtagagtaactcctcctgcagagcctcttgatagaatgccagatccttacgagccatcttatggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 350 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSYGRATTVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 351 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcagcgctttaaatgaatcagctcctgctgcatcttctgcaggaccttcttttagagctccagataaggatcgtagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaatgcagggatggcca

SEQ ID NO: 352 - protein, 387 aa, Artificial Sequence
  Varaint of Streptomyces mobaraensis Transglutaminase
MDNGAGEETKSYAETYRLTADDVANISALNESAPAASSAGPSFRAPDKDRRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNYDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRRWSHGYSDFDRGAYVITFIPKSWNTAPDKVMQGWPGQTGHHHHHH

SEQ ID NO: 353 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagatgtagatcgtagagtaactcctcctgcagagcctcttgatagaatgccagatccttacgagccatcttatggacgtgctgagacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcatttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtaatgcagggatggcca

SEQ ID NO: 354 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSHFYSALRNTPSFKERNGGNHDPSRMKAVIYSKHFWSGQDRSSSADKRKYGDPDAFRPAPGTGLVDMSKDRNIPRSPTSPGEGWVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 355 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttaccggccatcttatggacgtgctgagacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtaatgcagggatggcca

SEQ ID NO: 356 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 357 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagataaggatcgtagagtaactcctcctgcagagcctcttgatagaatgccagatccttacgagccatcttatggacgtgctgagacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtaatgcagggatggcca

SEQ ID NO: 358 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 359 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaatgcagggatggcca

SEQ ID NO: 360 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRRWSHGYSDFDRGAYVITFIPKSWNTAPDKVMQGWPGQTGHHHHHH

SEQ ID NO: 361 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagatgtagatcgtagagtaactcctcctgcagagcctcttgatagaatgccagatccttaccgaccatcttatggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtagtgcagggatggcca

SEQ ID NO: 362 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYRPSYGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNYDPSRMKAVIYSKHFWSGQDRSGSADKRKYGDPDAFRPAPGTGLVDMSRDRNIPRSPTSPGEGWVNFDYGWFGAQTEADADKTVWTHGNHYHAPNGSLGAMHVYESKFRRWSAGYSDFDRGAYVITFIPKSWNTAPDKVVQGWPGQTGHHHHHH

SEQ ID NO: 363 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagatgtagatcgtagagtaactcctcctgcagagcctcttgatagaatgccagatccttaccggccatctggaggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtaatgcagggatggcca

SEQ ID NO: 364 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYRPSGGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 365 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagatgtagatcgtagagtaactcctcctgcagagcctcttgatagaatgccagatccttaccggccatctggaggacgtgctgagacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcatttttattctgcacttagaaatacgccttctttcaaagaaagaaatggtggtaactatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtaatgcagggatggcca

SEQ ID NO: 366 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSHFYSALRNTPSFKERNGGNYDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 367 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcagcgctttaaatgaatcagctcctgctgcatcttctgcaggaccttcttttagagctccagatgtagatcgtagagtaactcctcctgcagagcctcttgatagaatgccagatccttacgagccatctggaggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaaaagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtactgcagggatggcca

SEQ ID NO: 368 - protein, 387 aa, Artificial Sequence
  Varaint of Streptomyces mobaraensis Transglutaminase
MDNGAGEETKSYAETYRLTADDVANISALNESAPAASSAGPSFRAPDVDRRVTPPAEPLDRMPDPYEPSGGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNYDPSRMKAVIYSKHFWSGQDRSGSADKRKYGDPDAFRPAPGTGLVDMSKDRNIPRSPTSPGEGFVNFDYGWFGAQTEADADKTVWTHGNHYHAPNGSLGAMHVYESKFRRWSAGYSDFDRGAYVITFIPKSWNTAPDKVLQGWPGQTGHHHHHH

SEQ ID NO: 369 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagatgtagatcgtagagtaactcctcctgcagagcctcttgatagaatgccagatccttacgagccatcttatggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaaaagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtaatgcagggatggcca

SEQ ID NO: 370 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYEPSYGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNYDPSRMKAVIYSKHFWSGQDRSGSADKRKYGDPDAFRPAPGTGLVDMSKDRNIPRSPTSPGEGFVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 371 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagataaggatcgtagagtaactcctcctgcagagcctcttgatagaatgccagatccttacgagccatctggaggacgtgctgagacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaatgcagggatggcca

SEQ ID NO: 372 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVMQGWPGQTGHHHHHH

SEQ ID NO: 373 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtaatgcagggatggcca

SEQ ID NO: 374 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 375 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagataaggatcgtagagtaactcctcctgcagagcctcttgatagaatgccagatccttacgagccatcttatggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtaatgcagggatggcca

SEQ ID NO: 376 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSYGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 377 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtaatgcagggatggcca

SEQ ID NO: 378 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNYDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 379 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagatgtagatcgtagagtaactcctcctgcagagcctcttgatagaatgccagatccttaccggccatctggaggacgtgctgagacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcatttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaaaagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtagtgcagggatggcca

SEQ ID NO: 380 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSHFYSALRNTPSFKERNGGNHDPSRMKAVIYSKHFWSGQDRSGSADKRKYGDPDAFRPAPGTGLVDMSKDRNIPRSPTSPGEGFVNFDYGWFGAQTEADADKTVWTHGNHYHAPNGSLGAMHVYESKFRRWSAGYSDFDRGAYVITFIPKSWNTAPDKVVQGWPGQTGHHHHHH

SEQ ID NO: 381 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagatgtagatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtaatgcagggatggcca

SEQ ID NO: 382 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 383 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagatgtagatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtactgcagggatggcca

SEQ ID NO: 384 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVLQGWPGQTGHHHHHH

SEQ ID NO: 385 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtagatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcatttttattctgcacttagaaatacgccttctttcaaagaaagaaatggtggtaaccatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtaatgcagggatggcca

SEQ ID NO: 386 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSHFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 387 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtagatcgtagagtaactcctcctgcagagcctcttgatagaatgccagatccttaccggccatcttatggacgtgctgagacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcatttttattctgcacttagaaatacgccttctttcaaagaaagaaatggtggtaactatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtagtgcagggatggcca

SEQ ID NO: 388 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSHFYSALRNTPSFKERNGGNYDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVVQGWPGQTGHHHHHH

SEQ ID NO: 389 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagatgtagatcgtagagtaactcctcctgcagagcctcttgatagaatgccagatccttacgagccatctggaggacgtgctgagacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcaggatattctgattttgatcgtggtgcttacgttatcacttttattccaaaatcttggaatactgcaccagataaagtaaagcagggatggcca

SEQ ID NO: 390 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVKQGWPGQTGHHHHHH

SEQ ID NO: 391 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattcttaccaaagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgcgcccaggtgaaggttttgtaaactttgattacggatggtttggagctcagacagaagctgatgcagataagacagtatggactcatggaaatcattatcacgctcctaacggttcggtcggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 392 - protein, 387 aa, Artificial Sequence
  Varaint of Streptomyces mobaraensis Transglutaminase
MDNGAGEETKSYAETYRLTADDVANINALNESAPAASSAGPSFRAPDSYQRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTRPGEGFVNFDYGWFGAQTEADADKTVWTHGNHYHAPNGSVGAMHVYESKFRRWSHGYSDFDRGAYVITFIPKSWNTAPDKVKQGWPGQTGHHHHHH

SEQ ID NO: 393 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgcgcccaggtgaaggttttgtaaactttgattacggatggtttggagctcagacagaagctgatgcagataagacagtatggactcatggaaatcattatcacgctcctaacggttatgtcggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 394 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTRPGEGFVNFDYGWFGAQTEADADKTVWTHGNHYHAPNGYVGAMHVYESKFRRWSHGYSDFDRGAYVITFIPKSWNTAPDKVKQGWPGQTGHHHHHH

SEQ ID NO: 395 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagcgccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccgagatcacctacgagtccaggtcgtggttatgtaaactttgattacggatggtttggagctcagacagaagctgatgcagataagacagtatggactcatggaaatcattatcacgctcctaatggtagcttaggtccgatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 396 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGRGYVNFDYGWFGAQTEADADKTVWTHGNHYHAPNGSLGPMHVYESKFRRWSHGYSDFDRGAYVITFIPKSWNTAPDKVKQGWPGQTGHHHHHH

SEQ ID NO: 397 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaatgggctagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttcggtcggtgcaatgcacgtatacgaatcaaaatttcgtaggtggtctcacggatatcgcgattttgatcgtggtgcttacgttatcacttttattccaaaatcttggaatactgcaccagataaagtaaagcagggatggccaggccaaactggccaccatcaccatcaccattag

SEQ ID NO: 398 - protein, 387 aa, Artificial Sequence
  Varaint of Streptomyces mobaraensis Transglutaminase
MDNGAGEETKSYAETYRLTADDVANINALNESAPAASSAGPSFRAPDKWARVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSVGAMHVYESKFRRWSHGYRDFDRGAYVITFIPKSWNTAPDKVKQGWPGQTGHHHHHH

SEQ ID NO: 399 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtagatcgtagagtaactcctcctgcagagcctcttgatagaatgccagatccttaccgaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtagtgcagggatggcca

SEQ ID NO: 400 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNYDPSRMKAVIYSKHFWSGQDRSGSADKRKYGDPDAFRPAPGTGLVDMSRDRNIPRSPTSPGEGWVNFDYGWFGAQTEADADKTVWTHGNHYHAPNGSLGAMHVYESKFRRWSAGYSDFDRGAYVITFIPKSWNTAPDKVVQGWPGQTGHHHHHH

SEQ ID NO: 401 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaaggggctagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgcgcccaggtgaaggttttgtaaactttgattacggatggtttggagctcagacagaagctgatgcagataagacagtatggactcatggaaatcattatcacgctcctaacggttcggtcggtgcaatgcacgtatacgaatcaaaatttcgtaggtggtctcacggatatagcgattttgatcgtggtgcttacgttatcacttttattccaaaatcttggaatactgcaccagataaagtaaagcagggatggccaggccaaactggccaccatcaccatcaccattag

SEQ ID NO: 402 - protein, 387 aa, Artificial Sequence
  Varaint of Streptomyces mobaraensis Transglutaminase
MDNGAGEETKSYAETYRLTADDVANINALNESAPAASSAGPSFRAPDKGARVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTRPGEGFVNFDYGWFGAQTEADADKTVWTHGNHYHAPNGSVGAMHVYESKFRRWSHGYSDFDRGAYVITFIPKSWNTAPDKVKQGWPGQTGHHHHHH

SEQ ID NO: 403 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagatgtagatcgtagagtaactcctcctgcagagcctcttgatagaatgccagatccttaccgaccatcttatggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtagtgcagggatggcca

SEQ ID NO: 404 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYRPSYGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNYDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVVQGWPGQTGHHHHHH

SEQ ID NO: 405 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgcgcccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatatcgcgattttgatcgtggtgcttacgttatcacttttattccaaaatcttggaatactgcaccagataaagtaaagcagggatggccaggccaaactggccaccatcaccatcaccattag

SEQ ID NO: 406 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTRPGEGFVNFDYGWFGAQTEADADKTVWTHGNHYHAPNGSLGAMHVYESKFRRWSHGYRDFDRGAYVITFIPKSWNTAPDKVKQGWPGQTGHHHHHH

SEQ ID NO: 407 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtagatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtaatgcagggatggcca

SEQ ID NO: 408 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNYDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 409 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtaaagcagggatggcca

SEQ ID NO: 410 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNYDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVKQGWPGQTGHHHHHH

SEQ ID NO: 411 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaagggcaaagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgcgcccaggtgaaggttttgtaaactttgattacggatggtttggagctcagacagaagctgatgcagataagacagtatggactcatggaaatcattatcacgctcctaacggttcggtcggtgcaatgcacgtatacgaatcaaaatttcgtaggtggtctcacggatatcgcgattttgatcgtggtgcttacgttatcacttttattccaaaatcttggaatactgcaccagataaagtaaagcagggatggccaggccaaactggccaccatcaccatcaccattag

SEQ ID NO: 412 - protein, 387 aa, Artificial Sequence
  Varaint of Streptomyces mobaraensis Transglutaminase
MDNGAGEETKSYAETYRLTADDVANINALNESAPAASSAGPSFRAPDKGQRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTRPGEGFVNFDYGWFGAQTEADADKTVWTHGNHYHAPNGSVGAMHVYESKFRRWSHGYRDFDRGAYVITFIPKSWNTAPDKVKQGWPGQTGHHHHHH

SEQ ID NO: 413 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgcgcccaggtgaaggttttgtaaactttgattacggatggtttggagctcagacagaagctgatgcagataagacagtatggactcatggaaatcattatcacgctcctaacggttcggtcggtgcaatgcacgtatacgaatcaaaatttcgtaggtggtctcacggatatcgcgattttgatcgtggtgcttacgttatcacttttattccaaaatcttggaatactgcaccagataaagtaaagcagggatggccaggccaaactggccaccatcaccatcaccattag

SEQ ID NO: 414 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTRPGEGFVNFDYGWFGAQTEADADKTVWTHGNHYHAPNGSVGAMHVYESKFRRWSHGYRDFDRGAYVITFIPKSWNTAPDKVKQGWPGQTGHHHHHH

SEQ ID NO: 415 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgcgcccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 416 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTRPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 417 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagatgtagatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaatgcagggatggcca

SEQ ID NO: 418 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRRWSHGYSDFDRGAYVITFIPKSWNTAPDKVMQGWPGQTGHHHHHH

SEQ ID NO: 419 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttatcctggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 420 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGYPGAMHVYESKFRRWSHGYSDFDRGAYVITFIPKSWNTAPDKVKQGWPGQTGHHHHHH

SEQ ID NO: 421 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagatgtagatcgtagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtagtgcagggatggcca

SEQ ID NO: 422 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNYDPSRMKAVIYSKHFWSGQDRSGSADKRKYGDPDAFRPAPGTGLVDMSRDRNIPRSPTSPGEGWVNFDYGWFGAQTEADADKTVWTHGNHYHAPNGSLGAMHVYESKFRRWSAGYSDFDRGAYVITFIPKSWNTAPDKVVQGWPGQTGHHHHHH

SEQ ID NO: 423 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagcgccagatgccgatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatctcgagatcacctacgaaaccaggtgagggttatgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 424 - protein, 387 aa, Artificial Sequence
  Varaint of Streptomyces mobaraensis Transglutaminase
MDNGAGEETKSYAETYRLTADDVANINALNESAPAASSAGPSFRAPDADRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNISRSPTKPGEGYVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 425 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtagatcgtagagtaactcctcctgcagagcctcttgatagaatgccagatccttaccgaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtaatgcagggatggcca

SEQ ID NO: 426 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNYDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 427 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtagatcgtagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtaatgcagggatggcca

SEQ ID NO: 428 - protein, 387 aa, Artificial Sequence
  Varaint of Streptomyces mobaraensis Transglutaminase
MDNGAGEETKSYAETYRLTADDVANINALNESAPAASSAGPSFRAPDVDRRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNYDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVMQGWPGQTGHHHHHH

SEQ ID NO: 429 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagataaggatcgtagagtaactcctcctgcagagcctcttgatagaatgccagatccttacgaaccatcttatggacgtgctacgacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 430 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSYGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNYDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 431 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtagtgcagggatggcca

SEQ ID NO: 432 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNYDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVVQGWPGQTGHHHHHH

SEQ ID NO: 433 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagataaggatcgtagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtagtgcagggatggcca

SEQ ID NO: 434 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNYDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVVQGWPGQTGHHHHHH

SEQ ID NO: 435 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaagatgctagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 436 - protein, 387 aa, Artificial Sequence; identical to SEQ ID NO: 258
  Varaint of Streptomyces mobaraensis Transglutaminase

SEQ ID NO: 437 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagatcgccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgaaaccaggtgagggttttgtaaactttgattacggatggtttggagctcagacagaagctgatgcagataagacagtatggactcatggaaatcattatcacgctcctgaaggtagcttaggtgcgatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 438 - protein, 387 aa, Artificial Sequence
  Varaint of Streptomyces mobaraensis Transglutaminase
MDNGAGEETKSYAETYRLTADDVANINALNESAPAASSAGPSFRSPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTKPGEGFVNFDYGWFGAQTEADADKTVWTHGNHYHAPEGSLGAMHVYESKFRRWSHGYSDFDRGAYVITFIPKSWNTAPDKVKQGWPGQTGHHHHHH

SEQ ID NO: 439 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgcgcccaggtgaaggttttgtaaactttgattacggatggtttggagctcagacagaagctgatgcagataagacagtatggactcatggaaatcattatcacgctcctaacggttcggtcggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 440 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTRPGEGFVNFDYGWFGAQTEADADKTVWTHGNHYHAPNGSVGAMHVYESKFRRWSHGYSDFDRGAYVITFIPKSWNTAPDKVKQGWPGQTGHHHHHH

SEQ ID NO: 441 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagcgccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgagggttttgtaaactttgattacggatggtttggagctcagacagaagctgatgcagataagacagtatggactcatggaaatcattatcacgctcctgaaggtagcttaggtccgatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 442 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPEGSLGPMHVYESKFRRWSHGYSDFDRGAYVITFIPKSWNTAPDKVKQGWPGQTGHHHHHH

SEQ ID NO: 443 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttcggtcggtgcaatgcacgtatacgaatcaaaatttcgtaggtggtctcacggatatcgcgattttgatcgtggtgcttacgttatcacttttattccaaaatcttggaatactgcaccagataaagtaaagcagggatggccaggccaaactggccaccatcaccatcaccattag

SEQ ID NO: 444 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSVGAMHVYESKFRRWSHGYRDFDRGAYVITFIPKSWNTAPDKVKQGWPGQTGHHHHHH

SEQ ID NO: 445 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagcgccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaatggtagcttaggtccgatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 446 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGPMHVYESKFRRWSHGYSDFDRGAYVITFIPKSWNTAPDKVKQGWPGQTGHHHHHH

SEQ ID NO: 447 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttcggtcggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 448 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSVGAMHVYESKFRRWSHGYSDFDRGAYVITFIPKSWNTAPDKVKQGWPGQTGHHHHHH

SEQ ID NO: 449 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagcgccagatgccgatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatctcgagatcacctacgtctccaggtgagggttatgtaaactttgattacggatggtttggagctcagacagaagctgatgcagataagacagtatggactcatggaaatcattatcacgctcctgaaggtagcttaggtccgatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 450 - protein, 387 aa, Artificial Sequence
  Varaint of Streptomyces mobaraensis Transglutaminase
MDNGAGEETKSYAETYRLTADDVANINALNESAPAASSAGPSFRAPDADRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNISRSPTSPGEGYVNFDYGWFGAQTEADADKTVWTHGNHYHAPEGSLGPMHVYESKFRRWSHGYSDFDRGAYVITFIPKSWNTAPDKVKQGWPGQTGHHHHHH

SEQ ID NO: 451 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtagtgcagggatggcca

SEQ ID NO: 452 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVVQGWPGQTGHHHHHH

SEQ ID NO: 453 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctgcgggatattctgattttgatcgtggtgcttacgttatcacttttattccaaaatcttggaatactgcaccagataaagtagtgcagggatggcca

SEQ ID NO: 454 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSAGYSDFDRGAYVITFIPKSWNTAPDKVVQGWPGQTGHHHHHH

SEQ ID NO: 455 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagcgccagatgccgatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 456 - protein, 387 aa, Artificial Sequence
  Varaint of Streptomyces mobaraensis Transglutaminase
MDNGAGEETKSYAETYRLTADDVANINALNESAPAASSAGPSFRAPDADRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 457 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagcgccagatgccgatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccgagatcacctacgaaaccaggtgagggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 458 - protein, 387 aa, Artificial Sequence
  Varaint of Streptomyces mobaraensis Transglutaminase
MDNGAGEETKSYAETYRLTADDVANINALNESAPAASSAGPSFRAPDADRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTKPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 459 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatctcgagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 460 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNISRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 461 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagcgccagatgccgatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagacggtaacatcccgagatcacctacgaaaccaggtgagggttttgtaaactttgattacggatggtttggagctcagacagaagctgatgcagataagacagtatggactcatggaaatcattatcacgctcctaacggttctttaggtccgatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 462 - protein, 387 aa, Artificial Sequence
  Varaint of Streptomyces mobaraensis Transglutaminase
MDNGAGEETKSYAETYRLTADDVANINALNESAPAASSAGPSFRAPDADRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDGNIPRSPTKPGEGFVNFDYGWFGAQTEADADKTVWTHGNHYHAPNGSLGPMHVYESKFRRWSHGYSDFDRGAYVITFIPKSWNTAPDKVKQGWPGQTGHHHHHH

SEQ ID NO: 463 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagatcgccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatctcgagatcacctacgagtccaggtgagggttttgtaaactttgattacggatggtttggagctcagacagaagctgatgcagataagacagtatggactcatggaaatcattatcacgctcctgaaggtagcttaggtccgatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 464 - protein, 387 aa, Artificial Sequence
  Varaint of Streptomyces mobaraensis Transglutaminase
MDNGAGEETKSYAETYRLTADDVANINALNESAPAASSAGPSFRSPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNISRSPTSPGEGFVNFDYGWFGAQTEADADKTVWTHGNHYHAPEGSLGPMHVYESKFRRWSHGYSDFDRGAYVITFIPKSWNTAPDKVKQGWPGQTGHHHHHH

SEQ ID NO: 465 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagcgccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatctcgagatcacctacgagtccaggtcgtggttatgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 466 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNISRSPTSPGRGYVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 467 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagcgccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatctcgagatcacctacgaaaccaggtgagggttatgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 468 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNISRSPTKPGEGYVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 469 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagcgccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccgagatcacctacgaaaccaggtgagggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 470 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTKPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 471 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 472 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 473 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagcgccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccgagatcacctacgagtccaggtcgtggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 474 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGRGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 475 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagcgccagatgccgatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgaaaccaggtgagggttatgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 476 - protein, 387 aa, Artificial Sequence
  Varaint of Streptomyces mobaraensis Transglutaminase
MDNGAGEETKSYAETYRLTADDVANINALNESAPAASSAGPSFRAPDADRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTKPGEGYVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 477 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccgagatcacctacgaaaccaggtgagggttatgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 478 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTKPGEGYVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 479 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagcgccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccgagatcacctacgagtccaggtgagggttatgtaaactttgattacggatggtttggagctcagacagaagctgatgcagataagacagtatggactcatggaaatcattatcacgctcctgaaggtagcttaggtgcgatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 480 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGYVNFDYGWFGAQTEADADKTVWTHGNHYHAPEGSLGAMHVYESKFRRWSHGYSDFDRGAYVITFIPKSWNTAPDKVKQGWPGQTGHHHHHH

SEQ ID NO: 481 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagcgccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatctcgagatcacctacgaaaccaggtcgtggttatgtaaactttgattacggatggtttggagctcagacagaagctgatgcagataagacagtatggactcatggaaatcattatcacgctcctaacggttctttaggtgcgatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 482 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNISRSPTKPGRGYVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 483 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagcgccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatctcgagatcacctacgagtccaggtgagggttttgtaaactttgattacggatggtttggagctcagacagaagctgatgcagataagacagtatggactcatggaaatcattatcacgctcctaatggtggcttaggtccgatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 484 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNISRSPTSPGEGFVNFDYGWFGAQTEADADKTVWTHGNHYHAPNGGLGPMHVYESKFRRWSHGYSDFDRGAYVITFIPKSWNTAPDKVKQGWPGQTGHHHHHH

SEQ ID NO: 485 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagcgccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatctcgagatcacctacgaaaccaggtgagggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggccaggccaaactggccaccatcaccatcaccattag

SEQ ID NO: 486 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNISRSPTKPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 487 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaatgcagggatggcca

SEQ ID NO: 488 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVMQGWPGQTGHHHHHH

SEQ ID NO: 489 - DNA, 1131 bp, Artificial Sequence
  Varaint of Streptomyces mobaraensis Transglutaminase
atggacaatggagctggtgaagaaacaaaatcttatgctgaaacatatagacttactgcagatgatgtagctaacatcaacgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttctagctcagctgataaacgtaagtacggtgaccctgatgcatttagaccagcacctggaacaggtcttgttgatatgtcaaaagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaggtggtctcacggatattctgattttgatcgtggtgcttacgttatcacttttattccaaaatcttggaatactgcaccagataaagtaaagcagggatggcca

SEQ ID NO: 490 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNYDPSRMKAVIYSKHFWSGQDRSSSADKRKYGDPDAFRPAPGTGLVDMSKDRNIPRSPTSPGEGFVNFDYGWFGAQTEADADKTVWTHGNHYHAPNGSLGAMHVYESKFRRWSHGYSDFDRGAYVITFIPKSWNTAPDKVKQGWPGQTGHHHHHH

SEQ ID NO: 491 - DNA, 1164 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaggatcgtagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacttaaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttatcttggtgcaatgcacgtatacgaatcaaaatttcgtaggtggtctcacggatatagcgattttgatcgtggtgcttacgttatcacttttattccaaaatcttggaatactgcaccagataaagtaaagcagggatggccaggccaaactggccaccatcaccatcaccattag

SEQ ID NO: 492 - protein, 387 aa, Artificial Sequence
  Varaint of Streptomyces mobaraensis Transglutaminase
MDNGAGEETKSYAETYRLTADDVANINALNESAPAASSAGPSFRAPDKDRRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGYLGAMHVYESKFRRWSHGYSDFDRGAYVITFIPKSWNTAPDKVKQGWPGQTGHHHHHH

SEQ ID NO: 493 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaagatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtcgttggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 494 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRRWSEGYSDFDRGAYVITFIPKSWNTAPDKVKQGWPGQTGHHHHHH

SEQ ID NO: 495 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccagaccaaactggccaccatcaccatcaccat

SEQ ID NO: 496 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPDQTGHHHHHH

SEQ ID NO: 497 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 498 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 499 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 500 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 501 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 502 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 503 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 504 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 505 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 506 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 507 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgctgggatggccaggccaaactggccaccatcaccatcaccat

SEQ ID NO: 508 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVLGWPGQTGHHHHHH

SEQ ID NO: 509 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacgaaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 510 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 511 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 512 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 513 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacgaaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 514 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 515 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 516 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 517 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 518 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 519 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 520 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 521 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 522 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 523 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgaatcttctgcaggaccttcttttagagctccagataaagatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcatggatattctgattttgatcgtggtgcttacgttatcacttttattccaaaatcttggaatactgcaccagataaagtaaagcagggatggccaggccaaactggccaccatcaccatcaccat

SEQ ID NO: 524 - protein, 387 aa, Artificial Sequence
  Varaint of Streptomyces mobaraensis Transglutaminase
MDNGAGEETKSYAETYRLTADDVANINALNESAPAESSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSHGYSDFDRGAYVITFIPKSWNTAPDKVKQGWPGQTGHHHHHH

SEQ ID NO: 525 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 526 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 527 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 528 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 529 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 530 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 531 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 532 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 533 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 534 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 535 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 536 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 537 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 538 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 539 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 540 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 541 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtcgttggtctcatggatattctgattttgatcgtggtgcttacgttatcacttttattccaaaatcttggaatactgcaccagataaagtaatgcagggatggccaggccaaactggccaccatcaccatcaccat

SEQ ID NO: 542 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVMQGWPGQTGHHHHHH

SEQ ID NO: 543 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 544 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 545 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 546 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 547 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 548 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 549 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacgaaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 550 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 551 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 552 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 553 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 554 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 555 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 556 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 557 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 558 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 559 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 560 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 561 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 562 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 563 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 564 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 565 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 566 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 567 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 568 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 569 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 570 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 571 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 572 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 573 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 574 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 575 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagatcctgctgcatcttctgcaggaccttcttttagagctccagattctgatgatagagtaactcctcctgcagagcctcttgatagaatgccagatccttacgaaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 576 - protein, 387 aa, Artificial Sequence
  Varaint of Streptomyces mobaraensis Transglutaminase
MDNGAGEETKSYAETYRLTADDVANINALNESDPAASSAGPSFRAPDSDDRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 577 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 578 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 579 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 580 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 581 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcatggatattctgattttgatcgtggtgcttacgttatcacttttattccaaaatcttggaatactgcaccagataaagtaatgcagggatggccaggccaaactggccaccatcaccatcaccat

SEQ ID NO: 582 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSHGYSDFDRGAYVITFIPKSWNTAPDKVMQGWPGQTGHHHHHH

SEQ ID NO: 583 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 584 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 585 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccattaccat

SEQ ID NO: 586 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHYH

SEQ ID NO: 587 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcatggatattctgattttgatcgtggtgcttacgttatcacttttattccaaaatcttggaatactgcaccagataaagtaaagcagggatggccaggccaaactggccaccatcaccatcaccat

SEQ ID NO: 588 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSHGYSDFDRGAYVITFIPKSWNTAPDKVKQGWPGQTGHHHHHH

SEQ ID NO: 589 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 590 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 591 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 592 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 593 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacgaaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 594 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 595 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 596 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 597 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 598 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 599 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 600 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 601 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 602 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 603 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgacttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaatgcagggatggccaggccaaactggccaccatcaccatcaccat

SEQ ID NO: 604 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTTSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVMQGWPGQTGHHHHHH

SEQ ID NO: 605 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 606 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 607 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 608 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 609 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaagatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtcgttggtctcatggatattctgattttgatcgtggtgcttacgttatcacttttattccaaaatcttggaatactgcaccagataaagtaatgcagggatggccaggccaaactggccaccatcaccatcaccat

SEQ ID NO: 610 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVMQGWPGQTGHHHHHH

SEQ ID NO: 611 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 612 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 613 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaagatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtcgttggtctcatggatattctgattttgatcgtggtgcttacgttatcacttttattccaaaatcttggaatactgcaccagataaagtaatgcagggatggccaggccaaactggccaccatcaccatcaccat

SEQ ID NO: 614 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRRWSHGYSDFDRGAYVITFIPKSWNTAPDKVMQGWPGQTGHHHHHH

SEQ ID NO: 615 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacgaaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 616 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYEPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 617 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 618 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 619 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 620 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 621 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcatggatattctgattttgatcgtggtgcttacgttatcacttttattccaaaatcttggaatactgcaccagataaagtaatgcagggatggccaggccaaactggccaccatcaccatcaccat

SEQ ID NO: 622 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSHGYSDFDRGAYVITFIPKSWNTAPDKVMQGWPGQTGHHHHHH

SEQ ID NO: 623 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaagatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtcgttggtctgaaggatattctgattttgatcgtggtgcttacgttatcacttttattccaaaatcttggaatactgcaccagataaagtaatgcagggatggccaggccaaactggccaccatcaccatcaccat

SEQ ID NO: 624 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRRWSEGYSDFDRGAYVITFIPKSWNTAPDKVMQGWPGQTGHHHHHH

SEQ ID NO: 625 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaagatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtcgttggtctgaaggatattctgattttgatcgtggtgcttacgttatcacttttattccaaaatcttggaatactgcaccagataaagtaatgcagggatggccaggccaaactggccaccatcaccatcaccat

SEQ ID NO: 626 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSEGYSDFDRGAYVITFIPKSWNTAPDKVMQGWPGQTGHHHHHH

SEQ ID NO: 627 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 628 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 629 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgttacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 630 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRYEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 631 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 632 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 633 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcatggatattctgattttgatcgtggtgcttacgttatcacttttattccaaaatcttggaatactgcaccagataaagtaatgcagggatggccaggccaaactggccaccatcaccatcaccat

SEQ ID NO: 634 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSHGYSDFDRGAYVITFIPKSWNTAPDKVMQGWPGQTGHHHHHH

SEQ ID NO: 635 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 636 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 637 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaaaagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 638 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNYDPSRMKAVIYSKHFWSGQDRSSSADKRKYGDPDAFRPAPGTGLVDMSKDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 639 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 640 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 641 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 642 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 643 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaaaagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 644 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSKDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 645 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 646 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 647 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacgaaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 648 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYEPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 649 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcatggatattctgattttgatcgtggtgcttacgttatcacttttattccaaaatcttggaatactgcaccagataaagtaaagcagggatggccaggccaaactggccaccatcaccatcaccat

SEQ ID NO: 650 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSHGYSDFDRGAYVITFIPKSWNTAPDKVKQGWPGQTGHHHHHH

SEQ ID NO: 651 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatctggcggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 652 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSGGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 653 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaagatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtcgttggtctgaaggatattctgattttgatcgtggtacttacgttatcacttttattccaaaatcttggaatactgcaccagataaagtaatgcagggatggccaggccaaactggccaccatcaccatcaccat

SEQ ID NO: 654 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRRWSEGYSDFDRGTYVITFIPKSWNTAPDKVMQGWPGQTGHHHHHH

SEQ ID NO: 655 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaagatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcatggatattctgattttgatcgtggtgcttacgttatcacttttattccaaaatcttggaatactgcaccagataaagtaatgcagggatggccaggccaaactggccaccatcaccatcaccat

SEQ ID NO: 656 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSHGYSDFDRGAYVITFIPKSWNTAPDKVMQGWPGQTGHHHHHH

SEQ ID NO: 657 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggacttatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 658 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTYGNHYHAPNGSLGAMHVYESKFRNWSEGYSDFDRGAYVITFIPKSWNTAPDKVVQGWPGQTGHHHHHH

SEQ ID NO: 659 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtcgttggtctgaaggatattctgattttgatcgtggtgcttacgttatcacttttattccaaaatcttggaatactgcaccagataaagtaatgcagggatggccaggccaaactggccaccatcaccatcaccat

SEQ ID NO: 660 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRRWSEGYSDFDRGAYVITFIPKSWNTAPDKVMQGWPGQTGHHHHHH

SEQ ID NO: 661 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaagatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtcgttggtctgaaggatattctgattttgatcgtggtgcttacgttatcacttttattccaaaatcttggaatactgcaccagataaagtaatgcagggatggccaggccaaactggccaccatcaccatcaccat

SEQ ID NO: 662 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRRWSEGYSDFDRGAYVITFIPKSWNTAPDKVMQGWPGQTGHHHHHH

SEQ ID NO: 663 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaagatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgatggatattctgattttgatcgtggtgcttacgttatcacttttattccaaaatcttggaatactgcaccagataaagtaatgcagggatggccaggccaaactggccaccatcaccatcaccat

SEQ ID NO: 664 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSDGYSDFDRGAYVITFIPKSWNTAPDKVMQGWPGQTGHHHHHH

SEQ ID NO: 665 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaatgcagggatggccaggccaaactggccaccatcaccatcaccat

SEQ ID NO: 666 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVMQGWPGQTGHHHHHH

SEQ ID NO: 667 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaagatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 668 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 669 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaatgcagggatggccaggccaaactggccaccatcaccatcaccat

SEQ ID NO: 670 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVMQGWPGQTGHHHHHH

SEQ ID NO: 671 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaatgcagggatggccaggccaaactggccaccatcaccatcaccat

SEQ ID NO: 672 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVMQGWPGQTGHHHHHH

SEQ ID NO: 673 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaagatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 674 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 675 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaagatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaatgcagggatggccaggccaaactggccaccatcaccatcaccat

SEQ ID NO: 676 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVMQGWPGQTGHHHHHH

SEQ ID NO: 677 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaagatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaatgcagggatggccaggccaaactggccaccatcaccatcaccat

SEQ ID NO: 678 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVMQGWPGQTGHHHHHH

SEQ ID NO: 679 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaatgcagggatggccaggccaaactggccaccatcaccatcaccat

SEQ ID NO: 680 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVMQGWPGQTGHHHHHH

SEQ ID NO: 681 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 682 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 683 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaagatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaatgcagggatggccaggccaaactggccaccatcaccatcaccat

SEQ ID NO: 684 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVMQGWPGQTGHHHHHH

SEQ ID NO: 685 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 686 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 687 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctaccacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 688 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSPFYSALRNTPSFKERNGGNYDPSRMKAVIYSKHFWSGQDRSSSADKRKYGDPDAFRPAPGTGLVDMSKDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 689 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctaccacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 690 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNYDPSRMKAVIYSKHFWSGQDRSSSADKRKYGDPDAFRPAPGTGLVDMSKDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 691 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctaccacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 692 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSNFYSALRNTPSFKERNGGNYDPSRMKAVIYSKHFWSGQDRSSSADKRKYGDPDAFRPAPGTGLVDMSKDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 693 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctaccacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 694 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSKDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 695 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 696 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSNFYSALRNTPSFKERNGGNYDPSRMKAVIYSKHFWSGQDRSSSADKRKYGDPDAFRPAPGTGLVDMSKDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 697 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctaccacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaaaagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 698 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNYDPSRMKAVIYSKHFWSGQDRSSSADKRKYGDPDAFRPAPGTGLVDMSKDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 699 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctaccacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 700 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNYDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 701 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctaccacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 702 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSKDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 703 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctaccacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 704 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 705 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctaccacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 706 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSKDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 707 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctaccacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgttactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 708 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNYDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRYWSAGYSDFDRGAYVITFIPKSWNTAPDKVKQGWPGQTGHHHHHH

SEQ ID NO: 709 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtcgttggtctgaaggatattctgattttgatcgtggtgcttacgttatcacttttattccaaaatcttggaatactgcaccagataaagtaatgcagggatggccaggccaaactggccaccatcaccatcaccat

SEQ ID NO: 710 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRRWSEGYSDFDRGAYVITFIPKSWNTAPDKVMQGWPGQTGHHHHHH

SEQ ID NO: 711 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctaccacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 712 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNYDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 713 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagatgtggatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacgtgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttctggctcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 714 - protein, 387 aa, Artificial Sequence
  Varaint of Streptomyces mobaraensis Transglutaminase
MDNGAGEETKSYAETYRLTADDVANINALNESAPAASSAGPSFRAPDVDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANVNDALRNEDARSPFYSALRNTPSFKERNGGNHDPSRMKAVIYSKHFWSGQDRSGSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 715 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 716 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNYDPSRMKAVIYSKHFWSGQDRSSSADKRKYGDPDAFRPAPGTGLVDMSKDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 717 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 718 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSPFYSALRNTPSFKERNGGNYDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 719 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctaccacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 720 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 721 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctaccacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 722 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 723 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 724 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSPFYSALRNTPSFKERNGGNYDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 725 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 726 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSKDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 727 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 728 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 729 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaaaagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 730 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSNFYSALRNTPSFKERNGGNYDPSRMKAVIYSKHFWSGQDRSSSADKRKYGDPDAFRPAPGTGLVDMSKDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 731 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 732 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 733 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctaccacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 734 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSPFYSALRNTPSFKERNGGNYDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 735 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 736 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSKDRNIPRSPTSPGEGWVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 737 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 738 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSNFYSALRNTPSFKERNGGNYDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 739 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctaccacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaaaagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgcgggatattctgattttgatcgtggtgcttacgttatcacttttattccaaaatcttggaatactgcaccagataaagtaaagcagggatggccaggccaaactggccaccatcaccatcaccat

SEQ ID NO: 740 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSKDRNIPRSPTSPGEGFVNFDYGWFGAQTEADADKTVWTHGNHYHAPNGSLGAMHVYESKFRNWSAGYSDFDRGAYVITFIPKSWNTAPDKVKQGWPGQTGHHHHHH

SEQ ID NO: 741 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctaccacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 742 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNYDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 743 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtagtgcagggatggccaggccaaactggccaccatcaccatcaccat

SEQ ID NO: 744 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVVQGWPGQTGHHHHHH

SEQ ID NO: 745 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaacaaagcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaacgttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 746 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNKALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSRDRNIPRSPTSPGERFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 747 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagataaagatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtaacatctgtaatgaaccgtgcattagagaacgctcatgacgagtcagcatatcttgataaccttaagaaggagcttgcaaacctgaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcagtcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctcatggatattctgattttgatcgtggtgcttacgttatcacttttattccaaaatcttggaatactgcaccagataaagtaatgcagggatggccaggccaaactggccaccatcaccatcaccat

SEQ ID NO: 748 - protein, 387 aa, Artificial Sequence
  Varaint of Streptomyces mobaraensis Transglutaminase
MDNGAGEETKSYAETYRLTADDVANINALNESAPAASSAGPSFRAPDKDDRVTPPAEPLDRMPDPYRPSYGRAETVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVTSVMNRALENAHDESAYLDNLKKELANLNDALRNEDARSPFYSALRNTPSFKERNGGNHDPSRMKAVIYSKHFWSGQDQSSSADKRKYGDPDAFRPAPGTGLVDMSRDRNIPRSPTSPGEGFVNFDYGWFGAQTEADADKTVWTHGNHYHAPNGSLGAMHVYESKFRNWSHGYSDFDRGAYVITFIPKSWNTAPDKVMQGWPGQTGHHHHHH

SEQ ID NO: 749 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 750 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSKDRNIPRSPTSPGEGWVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 751 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaactatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 752 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSPFYSALRNTPSFKERNGGNYDPSRMKAVIYSKHFWSGQDRSSSADKRKYGDPDAFRPAPGTGLVDMSRDRNIPRSPTSPGEGWVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 753 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctaccacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttttaaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctaacttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaagagaccgtaacatcccaagatcacctacgtctccaggtgaaggttttgtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 754 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRATTVVNNYIRKWQQVYSHRDGRKQQMTEEQREWLSYGCVGVTWVNSGQYPTNRLAFASFDEDRFKNELKNGRPRSGETRAEFEGRVAKESFDEEKGFQRAREVASVMNRALENAHDESAYLDNLKKELANGNDALRNEDARSNFYSALRNTPSFKERNGGNHDPSRMKAVIYSKHFWSGQDRSSSADKRKYGDPDAFRPAPGTGLVDMSRDRNIPRSPTSPGEGFVNFDYGWFGAQTEADADKTVWTHGNHYHAPNGSLGAMHVYESKFRNWSEGYSDFDRGAYVITFIPKSWNTAPDKVKQGWPGQTGHHHHHH

SEQ ID NO: 755 - DNA, 1161 bp, Artificial Sequence
  Varaint of Streptomyces mobaraensis Transglutaminase
atggacaatggagctggtgaagaaacaaaatcttatgctgaaacatatagacttactgcagatgatgtagctaacatcaatgctttaaatgaatcagctcctgctgcatcttctgcaggaccttcttttagagctccagattctgatgatagagtaactcctcctgcagagcctcttgatagaatgccagatccttacagaccatcttatggacgtgctgaaacagtagttaataactatattcgtaaatggcaacaggtttactctcatagagatggtcgtaaacaacaaatgacagaagagcagagagagtggctttcttatggatgcgttggagttacgtgggttaattcaggacaatatccaacgaaccgtcttgcatttgcttcttttgacgaagaccgttataaaaacgagcttaagaatggacgtcctcgttctggtgaaactcgtgctgagttcgaaggtagagttgctaaggaatctttcgatgaagaaaaaggatttcaaagagcacgtgaagtagcatctgtaatgaaccgtgcattagagaacgctcatgacgagtcagcatatcttgataaccttaagaaggagcttgcaaacggtaatgatgcacttcgtaacgaagacgcacgttctcctttttattctgcacttagaaatacgccttctttcaaagaaagaaatggtggtaaccatgatccatctagaatgaaagcagttatctattctaagcatttttggtctggtcaggatcgttcttcttcagctgataaacgtaagtacggtgaccctgatgcatttagaccagcacctggaacaggtcttgttgatatgtcaaaagaccgtaacatcccaagatcacctacgtctccaggtgaaggttgggtaaactttgattacggatggtttggagctcagacagaagctgatgcagataagacagtatggactcatggaaatcattatcacgctcctaacggttctttaggtgcaatgcacgtatacgaatcaaaatttcgtaactggtctgaaggatattctgattttgatcgtggtgcttacgttatcacttttattccaaaatcttggaatactgcaccagataaagtaaagcagggatggccaggccaaactggccaccatcaccatcaccat

SEQ ID NO: 756 - protein, 387 aa, Artificial Sequence
  Varaint of Streptomyces mobaraensis Transglutaminase
MDNGAGEETKSYAETYRLTADDVANINALNESAPAASSAGPSFRAPDSDDRVTPPAEPLDRMPDPYRPSYGRAETVVNNYIRKWQQVYSHRDGRKQQMTEEQREWLSYGCVGVTWVNSGQYPTNRLAFASFDEDRYKNELKNGRPRSGETRAEFEGRVAKESFDEEKGFQRAREVASVMNRALENAHDESAYLDNLKKELANGNDALRNEDARSPFYSALRNTPSFKERNGGNHDPSRMKAVIYSKHFWSGQDRSSSADKRKYGDPDAFRPAPGTGLVDMSKDRNIPRSPTSPGEGWVNFDYGWFGAQTEADADKTVWTHGNHYHAPNGSLGAMHVYESKFRNWSEGYSDFDRGAYVITFIPKSWNTAPDKVKQGWPGQTGHHHHHH

We claim:

1. An engineered transglutaminase having at least 90% sequence identity to the amino acid sequence of SEQ ID NO: 2 and having transglutaminase activity, wherein said engineered transglutaminase having at least 90% sequence identity to the amino acid sequence of SEQ ID NO: 2 comprises a substitution at one or more positions selected from positions 48, 203, 343, and 346, wherein said positions are numbered with reference to the amino acid sequence of SEQ ID NO: 2.

2. The engineered transglutaminase of claim 1, wherein said engineered transglutaminase having at least 90% sequence identity to the amino acid sequence of SEQ ID NO: 2 further comprises at least one substitution or substitution set at one or more positions selected from positions 48/67/70, 48/67/70/181/203/256, 48/67/70/181/256/345, 43/67/70/131/296/345/373, 43/67/70/203/256/296/345, 48/67/70/203/256/345/354/373, 48/67/70/203/345, 48/67/70/256, 48/67/70/256/296/345/373, 48/67/203/256/296/373, 48/67/203/256/345/373, 48/67/203/256/345, 48/70/170/203, 48/70/203/254/296/343, 48/70/203/256/345/373, 48/70/203/256/345, 48/70/203/373, 48/170/203, 48/170/203/254/296/346, 48/170/203/254/296/346/373, 48/170/203/254/346/373, 48/170/203/254/346, 48/170/203/296/343/346, 48/170/203/296/346/373, 48/170/203/343/346, 48/170/203/346, 48/170/203/346/373, 48/170/203/373, 48/170/254, 48/170/296, 48/170/296/343/346, 48/170/343/346, 48/181, 48/181/203/756/345, 48/181/203/345, 48/181/256/296/345, 48/181/296, 48/18 1/296/345, 48/203/254/296, 48/203/254/296/343/373, 48/203/254/296/346/373, 48/203/254/346, 48/203/254/346/373, 48/203/256, 48/203/256/296/345, 48/203/296/343/346/373, 48/203/296/343/373, 48/203/296/346, 48/203/296/346/373, 48/203/343/346/373, 48/203/345, 48/203/346/373, 48/254/296, 48/254/346, 48/256, 48/256/296, 48/256/296/345, 48/296/345, 48/296/373, 48/345/373, 67/256, 67/296/345, 68/74/190/215/346, 68/136/215/255/282/297/346, 68/136/215/297/346, 68/136/234, 68/158/174/234/282/297/346, 68/158/215/297/346, 68/215/297/346, 68/234, 68/282/297/346, 8/297/346, 74/136/174/282/346, 74/136/174/297/346, 74/136/346, 74/158/255/297, 74/255/346, 74/346, 136/158/190/215/255/297/346, 136/158/215/297/346, 136/174/215/255/282/297/346, 136/190/21.5/297/346, 136/215/234/282/297, 136/215/234/297/346, 136/215/297, 136/297/346, 158/215/255/346, 158/215/346, 170/203/254/296/343/346, 170/203/254/343/373, 170/203/343/346, 174/190/234/297/346, 174/215/234/297/346, 174/215/255/297/346, 174/282/297/346, 190/255/282/346, 190/297/346, 203/296, 215/255/297/346, 215/234/297/346, 215/255/297/346, 215/297, 215/297/346, 215/346, 234/255/346, 255/297/346, 255/346, 297/346, and 343/346/373, wherein said positions are numbered with reference to the amino add sequence of SEQ ID NO:2.

3. The engineered transglutaminase of claim 1, wherein said engineered transglutaminase comprises the amino add sequence of SEQ ID NO: 34 or 256.

4. The engineered transglutaminase of claim 1, wherein said engineered transglutaminase comprises the amino add sequence of SEQ ID NO: 256.

5. The engineered transglutaminase of claim 1, wherein said engineered transglutaminase is capable of modifying a free amine in insulin in the presence of a glutamine donor.

6. The engineered transglutaminase of claim 1, wherein said engineered transglutaminase is capable of modifying a glutamine in insulin in the presence of a iysine donor.

7. A method of modifying insulin comprising: providing insulin and the engineered transglutaminase of claim 1, combining said insulin, glutamine and said engineered transglutaminse under conditions such that said insulin is modified.

8. A method of modifying insulin comprising: providing insulin and the engineered transglutaminase of claim 1, combining said insulin, lysine and one said engineered transglutaminse under conditions such that said insulin is modified.

* * * * *